United States Patent
Cirpus et al.

(10) Patent No.: US 10,035,989 B2
(45) Date of Patent: Jul. 31, 2018

(54) METHOD FOR PRODUCING POLYUNSATURATED FATTY ACIDS IN TRANSGENIC PLANTS

(71) Applicant: BASF Plant Science GmbH, Ludwigshafen (DE)

(72) Inventors: Petra Cirpus, Mannheim (DE); Jörg Bauer, Ludwigshafen (DE); Xiao Qiu, Saskatoon (CA); Guohai Wu, Saskatoon (CA); Nagamani Datla, Saskatoon (CA)

(73) Assignee: BASF Plant Science GmbH, Ludwigshafen (DE)

( * ) Notice: Subject to any disclaimer, the term of this patent is extended or adjusted under 35 U.S.C. 154(b) by 159 days.

(21) Appl. No.: 14/823,253

(22) Filed: Aug. 11, 2015

(65) Prior Publication Data

US 2015/0361404 A1    Dec. 17, 2015

Related U.S. Application Data

(63) Continuation of application No. 10/590,457, filed as application No. PCT/EP2005/001863 on Feb. 23, 2005, now Pat. No. 9,458,436.

(30) Foreign Application Priority Data

| Feb. 27, 2004 | (DE) | ................... | 10 2004 009 457 |
| Mar. 13, 2004 | (DE) | ................... | 10 2004 012 370 |
| Apr. 8, 2004 | (DE) | ................... | 10 2004 017 518 |
| May 14, 2004 | (DE) | ................... | 10 2004 024 014 |
| Jul. 16, 2004 | (EP) | ................... | PCT/EP2004/007957 |
| Dec. 24, 2004 | (DE) | ................... | 10 2004 062 543 |

(51) Int. Cl.

| C12N 15/82 | (2006.01) |
| C12N 9/02 | (2006.01) |
| A23D 9/00 | (2006.01) |
| A61K 8/92 | (2006.01) |
| A61Q 19/00 | (2006.01) |
| C12N 9/10 | (2006.01) |
| A61K 8/36 | (2006.01) |
| A61K 31/202 | (2006.01) |

(52) U.S. Cl.
CPC ............ *C12N 9/0071* (2013.01); *A23D 9/00* (2013.01); *A61K 8/361* (2013.01); *A61K 8/922* (2013.01); *A61K 31/202* (2013.01); *A61Q 19/00* (2013.01); *C12N 9/0083* (2013.01); *C12N 9/1029* (2013.01); *C12N 15/8247* (2013.01); *A61K 2800/86* (2013.01); *C12Y 114/19* (2013.01)

(58) Field of Classification Search
None
See application file for complete search history.

(56) References Cited

U.S. PATENT DOCUMENTS

| 5,614,393 | A | 3/1997 | Thomas et al. |
| 6,043,411 | A | 3/2000 | Nishizawa et al. |
| 6,194,167 | B1 | 2/2001 | Browse et al. |
| 6,459,018 | B1 | 10/2002 | Knutzon |
| 6,884,921 | B2 | 4/2005 | Browse et al. |
| 7,211,656 | B2 | 5/2007 | Mukerji et al. |
| 7,238,851 | B2 | 7/2007 | Kang |
| 7,550,286 | B2 | 6/2009 | Damude et al. |
| 7,777,098 | B2 | 8/2010 | Cirpus et al. |
| 8,049,064 | B2 | 11/2011 | Cirpus et al. |
| 8,088,974 | B2 | 1/2012 | Lerchl et al. |
| 8,455,035 | B2 | 6/2013 | Rein et al. |
| 8,785,727 | B2 | 7/2014 | Bauer et al. |
| 8,993,841 | B2 | 3/2015 | Napier et al. |
| 9,458,436 | B2 | 10/2016 | Cirpus et al. |
| 9,493,520 | B2 | 11/2016 | Bauer et al. |
| 2003/0163845 | A1 | 8/2003 | Mukerji et al. |
| 2003/0196217 | A1 | 10/2003 | Mukerji et al. |
| 2004/0049805 | A1 | 3/2004 | Lerchl et al. |
| 2004/0053379 | A1 | 3/2004 | Lerchl et al. |
| 2004/0111763 | A1 | 6/2004 | Heinz et al. |
| 2004/0172682 | A1 | 9/2004 | Kinney et al. |
| 2008/0076164 | A1 | 3/2008 | Cirpus et al. |
| 2008/0155705 | A1 | 6/2008 | Zank et al. |
| 2009/0222951 | A1 | 9/2009 | Cirpus et al. |
| 2010/0021976 | A1 | 1/2010 | Lerchl et al. |
| 2013/0116421 | A1 | 5/2013 | Cirpus et al. |

FOREIGN PATENT DOCUMENTS

| AU | 2001239244 B2 | 8/2001 |
| AU | 2003232512 B2 | 11/2003 |
| AU | 2003258496 A1 | 1/2004 |
| AU | 2004215705 B2 | 9/2004 |
| AU | 2004225838 B2 | 10/2004 |

(Continued)

OTHER PUBLICATIONS

Broun et al, Science 282: 1315-1317, Nov. 13, 1998.*

(Continued)

*Primary Examiner* — Elizabeth F McElwain
(74) *Attorney, Agent, or Firm* — Drinker Biddle & Reath LLP

(57) ABSTRACT

The present invention relates to a process for the production of polyunsaturated fatty acids in the seed of transgenic plants by introducing, into the organism, nucleic acids which encode polypeptides with a ω3-desaturase, Δ12-desaturase, Δ6-desaturase, Δ6-elongase, Δ5-desaturase, Δ5-elongase and/or Δ4-desaturase activity. The invention furthermore relates to recombinant nucleic acid molecules comprising the nucleic acid sequences which encode the aforementioned polypeptides, either jointly or individually, and transgenic plants which comprise the aforementioned recombinant nucleic acid molecules. Furthermore, the invention relates to the generation of a transgenic plant and to oils, lipids and/or fatty acids with an elevated content of polyunsaturated fatty acids, in particular arachidonic acid, eicosapentaenoic acid and/or docosahexaenoic acid, as the result of the expression of the elongases and desaturases used in the process according to the invention.

20 Claims, 33 Drawing Sheets

(56) References Cited

FOREIGN PATENT DOCUMENTS

| | | |
|---|---|---|
| AU | 2004227075 B8 | 10/2004 |
| AU | 2005217080 B2 | 9/2005 |
| CA | 2 485 060 | 11/2003 |
| CA | 2559360 A1 | 9/2005 |
| DE | 101 02 337 A1 | 7/2002 |
| DE | 102 19 203 | 11/2003 |
| EP | 0 550 162 | 7/1993 |
| EP | 0 794 250 | 9/1997 |
| WO | WO-91/13972 | 9/1991 |
| WO | WO-93/06712 | 4/1993 |
| WO | WO-93/11245 | 6/1993 |
| WO | WO-94/11516 | 5/1994 |
| WO | WO-94/18337 | 8/1994 |
| WO | WO-95/18222 A1 | 7/1995 |
| WO | WO-96/21022 | 7/1996 |
| WO | WO-97/21340 | 6/1997 |
| WO | WO-97/30582 | 8/1997 |
| WO | WO-98/46763 | 10/1998 |
| WO | WO-98/46764 | 10/1998 |
| WO | WO-98/46765 | 10/1998 |
| WO | WO-98/46776 | 10/1998 |
| WO | WO-99/27111 | 6/1999 |
| WO | WO-99/64616 | 12/1999 |
| WO | WO-00/12720 | 3/2000 |
| WO | WO-00/21557 | 4/2000 |
| WO | WO-00/34439 A1 | 6/2000 |
| WO | WO-01/59128 | 8/2001 |
| WO | WO-01/85968 A2 | 11/2001 |
| WO | WO-02/08401 | 1/2002 |
| WO | WO-02/26946 A2 | 4/2002 |
| WO | WO-02/44320 | 6/2002 |
| WO | WO-02/057464 A2 | 7/2002 |
| WO | WO-02/057465 A2 | 7/2002 |
| WO | WO-02/077213 | 10/2002 |
| WO | WO-02/081668 A2 | 10/2002 |
| WO | WO-02/090493 A2 | 11/2002 |
| WO | WO-02/092540 A1 | 11/2002 |
| WO | WO-03/064596 A2 | 8/2003 |
| WO | WO-03/102138 A2 | 12/2003 |
| WO | WO-2004/005442 A1 | 1/2004 |
| WO | WO-2004/057001 A2 | 7/2004 |
| WO | WO-2004/071467 | 8/2004 |
| WO | WO-2005/012316 A2 | 2/2005 |
| WO | WO-2005/083053 A2 | 9/2005 |
| WO | WO-2005/083093 A2 | 9/2005 |
| WO | WO-2005/103253 A1 | 11/2005 |
| WO | WO-2006/008099 A2 | 1/2006 |
| WO | WO-2010/057246 A1 | 5/2010 |

OTHER PUBLICATIONS

Van de Loo et al, PNAS, USA 92:6743-6747, Jul. 1995.*
Doerks et al, TIG 14(6): 248-250, Jun. 1998.*
Brenner, S.E., TIG 15(4): 132-133, Apr. 1999.*
Bork et al, TIG 12(10): 425-427, Oct. 1996.*
Cronan, J.E. et al., "Biosynthesis of Membrane Lipids", in "*E. coli and Salmonella*", Section B2, Neidhardt, F.C. et al. eds., ASM Press, Washington, DC, (1996), pp. 612-636.
Gerhardt, B., "Fatty Acid Degradation in Plants", Prog. Lipid Res. 31:4 (1992), pp. 417-446.
Wada, H. et al., "Enhancement of Chilling Tolerance of a Cyanobacterium by Genetic Manipulation of Fatty Acid Desaturation", Nature 347 (1990), pp. 200-203.
Yu, R. et al., "Production of Eicosapentaenoic Acid by a Recombinant Marine Cyanobacterium, *Synechococcus* sp.", Lipids, 35:10 (2000), pp. 1061-1064.
Magnuson, K. et al., "Regulation of Fatty Acid Biosynthesis in *Escherichia coli*", Microbiological Reviews, 57:3 (1993), pp. 522-542.
Akimoto, M. et al., "Carbon Dioxide Fixation and Polyunsaturated Fatty Acid Production by the Red Alga *Porphyridium Cruentum*", Applied Biochemistry and Biotechnology 73 (1998), pp. 269-278.

Stymne, S., "Biosynthesis of 'Uncommon' Fatty Acids and Their Incorporation into Triacylglycerols", Biochemistry and Molecular Biology of Membrane and Storage Lipids of Plants, N. Murata et al., Editors, The American Society of Plant Physiologists (1993), pp. 150-158.
Frentzen, M., "Acyltransferases from Basic Science to Modified Seed Oils", Fett/Lipid, 100:4-5, S. (1998), pp. 161-166.
Shanklin, J. et al., "Desaturation and Related Modifications of Fatty Acids", Annu. Rev. Plant Physiol. Plant Mol. Biol. 49 (1998), pp. 611-641.
Drexler, H. et al., "Metabolic Engineering of Fatty Acids for Breeding of New Oilseed Crops: Strategies, Problems and First Results", J. Plant Physiol. 160 (2003), pp. 779-802.
Domergue, F. et al., "Cloning and Functional Characterization of *Phaeodactylum tricornutum* Front-End Desaturases Involved in Eicosapentaenoic Acid Biosynthesis", Eur. J. Biochem. 269 (2002), pp. 4105-4113.
Totani, N. et al., "The Filamentous Fungus *Mortierella alpina*, High in Arachiodonic Acid", Lipids, 22:2 (1987), pp. 1060-1062.
Cleland, L.G. et al., "Fish Oil and Rheumatoid Arthritis: Antiinflammatory and Collateral Health Benefits", The Journal of Rheumatology, 27:10 (2000), pp. 2305-2307.
Vazhappilly, R. et al., "Heterotrophic Production Potential of Omega-3 Polyunsaturated Fatty Acids by Microalgae and Algae-like Microorganisms", Botanica Marina 41 (1998), pp. 553-558.
Tvrdik, P. et al., "Role of a New Mammalian Gene Family in the Biosynthesis of Very Long Chain Fatty Acids and Sphingolipids", The Journal of Cell Biology, 149:3 (2000) pp. 707-717.
Guehnemann-Schaefer, K. et al., "Fatty Acid β-oxidation in Glyoxysomes. Characterization of a New Tetrafunctional Protein (MFPIII)", Biochimica et Biophysica Acta 1256 (1995), pp. 181-186.
Meyer, A. et al., "Novel Fatty Acid Elongases and Their Use for the Reconstitution of Docosahexaenoic Acid Biosynthesis", Journal of Lipid Research 45 (2004), pp. 1899-1909.
Sakuradani, E. et al., "Δ6-Fatty Acid Desaturase from an Arachidonic Acid-Producing *Mortierella* Fungus Gene Cloning and Its Heterologous Expression in a Fungus, *Aspergillus*", Gene 238 (1999), pp. 445-453.
Kinney, A.J., "Genetic Engeering of Oilseeds for Desired Traits", in "Genetic Engineering, Principles and Methods", vol. 19, Editor: J. Setlow, pp. 149-166.
Voelker, T., "Plant Acyl-ACP Thioesterases: Chain-Length Determining Enzymes in Plant Fatty Acid Biosynthesis", in "Genetic Engineering, Principles and Methods", vol. 18, Editor: J. Setlow, pp. 111-113.
Stukey, J.E. et al., "The OLE1 Gene of *Saccharomyces cerevisiae* Encodes the Δ9 Fatty Acid Desaturase and Can Be Functionally Replaced by the Rat Stearoyl-CoA Desaturase Gene", The Jounal of Biological Chemistry 265:33 (1990), pp. 20144-20149.
Zank, T.K. et al., "Cloning and Functional Expression of the First Plant Fatty Acid Elongase Specific for Δ6-Polyunsaturated Fatty Acids", Biochemical Society Transactions 28:6 (2000), pp. 654-658.
Poulos, A., "Very Long Chain Fatty Acids in Higher Animals—A Review", Lipids 30:1 (1995), pp. 1-14.
Huang, Y-S. et al., "Cloning of Δ12- and Δ6-Desaturases from *Mortierella alpina* and Recombinant Production of γ-Linolenic Acid in *Saccharomyces cerevisiae*", Lipids 34:7 (1999), pp. 649-659.
Tocher, D.R. et al., "Recent Advances in the Biochemistry and Molecular Biology of Fatty Acyl Desaturases", Prog. Lipid Res. 37:2/3 (1998), pp. 73-117.
Horrocks, L.A. et al., "Health Benefits of Docosahexaenoic Acid (DHA)", Pharmacological Research 40:3 (1999), pp. 211-225.
McKeon, T. et al., "Stearoyl-Acyl Carrier Protein Desaturase from Safflower Seeds", in Methods in Enzymology, vol. 71, Part C: Lipids, Editor: J. Lowenstein (1981), New York, pp. 275-281.
Takeyama, H. et al., "Expression of the Eicosapentaenoic Acid Synthesis Gene Cluster from *Shewanella* sp. in a Transgenic Marine Cyanobacterium, *Synechococcus* sp.", Microbiology 143 (1997), pp. 2725-2731.

(56) References Cited

OTHER PUBLICATIONS

Murphy, D.J. et al., "Biosynthesis, Targeting and Processing of Oleosin-like Proteins, Which are Major Pollen Coat Components in *Brassica napus*", The Plant Journal 13:1 (1998), pp. 1-16.
Wang, X.-M. et al., "Biosynthesis and Regulation of Linolenic Acid in Higher Plants", Physiol. Biochem. 26:6 (1988), pp. 777-792.
Zank, T.K. et al., "Cloning and Functional Characterisation of an Enzyme Involved in the Elongation of Δ6-polyunsaturated Fatty Acids from the Moss *Physcomitrella patens*", The Plant Journal 31:3 (2002), pp. 255-268.
Millar, A.A. et al., "CUT1, an Arabidopsis Gene Required for Cuticular Wax Biosynthesis and Pollen Fertility, Encodes a Very-Long-Chain Fatty Acid Condensing Enzyme", The Plant Cell 11 (1999), pp. 825-838.
Calder, P.C., "Dietary Modification of Inflammation with Lipids", Proceedings of the Nutrition Society 61 (2002), pp. 345-358.
Kunau, W.-H., et al., "β-oxidation of Fatty Acids in Mitochondria, Peroxisomes, and Bacteria: A Century of Continued Progress", Prog. Lipid Res. 34:4 (1995), pp. 267-342.
Beaudoin, F. et al., "Heterologous Reconstitution in Yeast of the Polyunsaturated Fatty Acid Biosynthetic Pathway", Proceedings of the National Academy of Sciences of the United States of America 97:12 (2000), pp. 6421-6426.
Ohlrogge, J. et al., "Lipid Biosynthesis", The Plant Cell 7 (1995), pp. 957-970.
Millar, A.A. et al., "Very-long-chain Fatty Acid Biosynthesis is Controlled through the Expression and Specificity of the Condensing Enzyme", The Plant Journal 12:1 (1997), pp. 121-131.
Shimokawa, H., "Beneficial Effects of Eicosapentaenoic Acid on Endothelial Vasodilator Functions in Animals and Humans", World Rev. Nutr. Diet 88 (2001), pp. 100-108.
Chalova, L. I., et al. "The Composition of Lipids of Phytophthora infestans and Their Ability to Induce Potato Phytoalexin Accumulation". Biokhimiya, 1987, vol. 52, No. 9, pp. 1445-1453; also see Database BIOSIS, Abstract No. PREV198885045135.
Abbadi, A. et al., "Biosynthesis of Very-Long-Chain Polyunsaturated Fatty Acids in Transgenic Oilseeds: Constraints on Their Accumulation", The Plant Cell 16 (2004), pp. 2734-2748.
"My-26-A-10 PinfestansMY Phytophthora infestans cDNA, mRNA sequence." Database EMBL, Accession No. BE777235, Sep. 21, 2000.
Kamoun, S. et al., "Initial Assessment of Gene Diversity for the Oomycete Pathogen *Phytophthora infestans* Based on Expressed Sequences", Fungal Genetics and Biology 28 (1999), pp. 94-106.
Khozin, I. et al., "Elucidation of the Biosynthesis of Eicosapentaenoic Acid in the Microalga *Porphyridium cruentum*", Plant Physiol. 114 (1997), pp. 223-230.
Pereira, S.L. et al., "A Novel ω3-Fatty Acid Desaturase Involved in the Biosynthesis of Eicosapentaenoic Acid", Biochem. J. 378 (2004), pp. 665-671.
Pereira, S.L. et al., "Recent Advances in the Study of Fatty Acid Desaturases from Animals and Lower Eukaryotes", Prostaglandins, Leukotrienes and Essential Fatty Acids 68 (2003), pp. 97-106.
Spychalla, J.P. et al., "Identification of an Animal ω-3 Fatty Acid Desaturase by Heterologous Expression in *Arabidopsis*", Proc. Natl. Acad. Sci. USA 94 (1997), pp. 1142-1147.
Kajikawa, M., et al., "Isolation and Functional Characterization of Fatty Acid Δ5-Elongase Gene from the Liverwort *Marchantia polymorpha* L.", FEBS Letters, 2006, vol. 580, pp. 149-154.
Robert, S. S., et al., "Isolation and Characterisation of a Δ5-Fatty Acid Elongase from the Marine Microalga *Pavlova salina*", Mar. Biotechnol., 2009, vol. 11, pp. 410-418.
Pereira, S. L., et al., "Identification of Two Novel Microalgal Enzymes Involved in the Conversion of the ω3-Fatty Acid, Eicosapentaenoic Acid, into Docosahexaenoic Acid", Biochem. J., 2004, vol. 384, pp. 357-366.
Leonard, A. E., et al., "Elongation of Long-Chain Fatty Acids", Progress in Lipid Research, 2004, vol. 43, pp. 36-54.
Sperling, P., et al., "The Evolution of Desaturases", Prostaglandins, Leukotrienes and Essential Fatty Acids, 2003, vol. 68, pp. 73-95.

Domergue, F., et al., "New Insight into *Phaeodactylum tricornutum* Fatty Acid Metabolism. Cloning and Functional Characterization of Plastidial and Microsomal Δ12-Fatty Acid Desaturases", Plant Physiology, 2003, vol. 131, pp. 1648-1660.
Wu, G., et al., "Stepwise Engineering to Produce High Yields of Very Long-Chain Polyunsaturated Fatty Acids in Plants", Nature Biotechnology, 2005, vol. 23, No. 8, pp. 1013-1017.
Nakamura, M. T., et al., "Structure, Function, and Dietary Regulation of Δ6, Δ5, and Δ9 Desaturases", Annu. Rev. Nutr., 2004, vol. 24, pp. 345-376.
"P. patens Delta6 Elongase SEQ ID 29", GeneSeq Database Accession No. ABG73608, Mar. 25, 2003.
"Subname: Full = Polyunsaturated Fatty Acid Elongase elvol5a", UniProt Database Accession No. Q8AWE7, Oct. 25, 2005.
"Polyunsaturated Fatty Acid Elongase (ELOVL Family Member 5, Elongation of Long Chain Fatty Acids) (YEAST)", UniProt Database Accession No. Q8AX86, Mar. 1, 2003.
"633167 NCCCWA 1 RT Oncorhynchus Mykiss cDNA Clone 1RT126D03_B_B02 5', mRNA Sequence", EMBL Database Accession No. CA360014, Nov. 7, 2002.
"LOC398440 Protein", UniProt Database Accession No. Q7ZXJ4, Jun. 1, 2003.
Huang, Y.-S., et al., "Enzymes for Transgenic Biosynthesis of Long-Chain Polyunsaturated Fatty Acids", Biochimie, 2004, vol. 86, No. 11, pp. 793-798.
"Physcomitrella patens Desaturase Encoding cDNA SEQ ID No. 7", GeneSeq Database Accession No. ABV74260, Mar. 28, 2003.
"Phaeodactylum tricornutum Desaturase Encoding cDNA SEQ ID No. 11", GeneSeq Database Accession No. ABV74262, Mar. 28, 2003.
Sprecher, H. "Metabolism of Highly Unsaturated n-3 and n-6 Fatty Acids", Biochimica et Biophysica Acta, 2000, vol. 1486, pp. 219-231.
"Nouveau Dictionnaire des Huiles Végétales: Compositions en Acides Gras", Ucciani E., Ed. Technique & Documentation—Lavoisier, 1995, ISBN: 2-7430-0009-0, pp. 577, 578 and 582.
"Phaeodactylum tricornutum Elongase Encoding cDNA SEQ ID No. 9",GeneSeq Database Accession No. ABV74261, Mar. 28, 2003.
Bork, P., et al., "Go Hunting in Sequence Databases but Watch Out for the Traps", Trends in Genet. 12:10 (1996), pp. 425-427.
Broun, P., et al., "Catalytic Plasticity of Fatty Acid Modification Enzymes Underlying Chemical Diversity of Plant Lipids", Science 282:5392 (1998), pp. 1315-1317.
Van de Loo, F. J., et al., "An Oleate 12-Hydroxylase from *Ricinus communis* L. is a Fatty Acyl Desaturase Homolog", Proc. Natl. Acad. Sci. U S A 92:15 (1995), pp. 6743-6747.
Doerks, T., et al., "Protein Annotation: Detective Work for Function Prediction", Trends in Genet. 14:6 (1998), pp. 248-250.
Brenner, S. E., "Errors in Genome Annotation", Trends in Genet. 15:4 (1999), pp. 132-133.
Domergue, F., et al., "Acyl Carriers Used as Substrates by the Desaturases and Elongases Involved in Very Long-chain Polyunsaturated Fatty Acids Biosynthesis Reconstituted in Yeast", The Journal of Biological Chemistry, 2003, vol. 278, No. 37, pp. 35515-35126.
Gunstone, F. D., "Vegetable Oils", In: Bailey's Industrial Oil and Fat Products, Sixth Edition, Six Volume Set, pp. 213-267, Ed. Shahidi, John Wiley & Sons, Inc., 2005.
Ursin, V., et al., "Production of Beneficial Dietary Omega-3 and Omega 6 Fatty Acids in Transgenic Canola", Abstract No. 49, 14th International Symposium Plant Lipids, 2000.
U.S. Appl. No. 60/613,861, Singh et al.
Wolff, R. L., et al., "Arachidonic, Eicosapentaenoic, and Biosynthetically Related Fatty Acids in the Seed Lipids from a Primitive Gymnosperm, *Agathis robusta*", Lipids, 1999, vol. 34, No. 10, pp. 1083-1097.
Hong, H., et al., "High-Level Production of γ-Linolenic Acid in *Brassica juncea* Using a Δ6 Desaturase from *Pythium irregulare*", Plant Physiology, 2002, vol. 129, pp. 354-362.
Abbadi, A., et al., "Transgenic Oilseeds as Sustainable Source of Nutritionally Relevant C20 and C22 Polyunsaturated Fatty Acids?", Eur. J. Lipid Sci. Technol., 2001, vol. 103, pp. 106-113.

(56) References Cited

OTHER PUBLICATIONS

Sayanova, O. V., et al., "Eicosapentaenoic Acid: Biosynthetic Routes and the Potential for Synthesis in Transgenic Plants", Phytochemistry, 2004, vol. 65, pp. 147-158.

Heinz, E., "Docosahexaenoic Acid (DHA) in Transgenic Oilseeds: Which Approach Will Be Successful First?", European Journal of Lipid Science and Technology, 2002, vol. 104, pp. 1-2.

Lui, J.-W., et al., "Evaluation of the Seed Oils from a Canola Plant Genetically Transformed to Produce High Levels of γ-Linolenic Acid", Chapter 7 in "γ-Linolenic acid: Recent Advances in Biotechnology and Clinical Applications", Eds. Huang and Ziboh, AOCS Press, Champaign, Illinois, 2001, pp. 61-71.

Derelle, E., et al., "DNA Libraries for Sequencing the Genome of Ostreococcus laud (Chlorophyta, Prasinophyceae): The Smallest Free-Living Eukaryotic Cell", J. Phycol, 2002, vol. 38, pp. 1150-1156.

Derelle, E., et al., "Genome Analysis of the Smallest Free-Living Eukaryote Ostreococcus tauri Unveils Many Unique Features", PNAS, 2006, vol. 103, No. 31, pp. 11647-11652.

Ral, J.-P., et al., "Starch Division and Partitioning. A Mechanism for Granule Propagation and Maintenance in the Picophytoplanktonic Green Alga Ostreococcus tauri", Plant Physiology, 2004, vol. 136, pp. 3333-3340.

"Ostreococcus tauri Delta-6-Desaturase (d6) Gene, Complete cds", Database EMBL Accession No. AY746357, Jul. 8, 2005.

Sayanova, O. V., et al., "Identification of Primula Fatty Acid $\Delta^6$-Desaturases with n-3 Substrate Preferences", FEBS Letters, 2003, vol. 542, pp. 100-104.

Beaudoin, F., et al., "Production of $C_{20}$ Polyunsaturated Fatty Acids (PUFAs) by Pathway Engineering: Identification of a PUFA Elongase Component from Caenorhabditis elegans", Biochemical Society Transactions, 2000, vol. 28, pp. 661-663.

Parker-Barnes, J. M., et al., "Identification and Characterization of an Enzyme Involved in the Elongation of n-6 and n-3 Polyunsaturated Fatty Acids", PNAS, vol. 97, 2000, vol. 97, No. 15, pp. 8284-8289.

Thurmond, T. Das J. M., et al., "Polyunsaturated Fatty Acid-Specific Elongation Enzymes", Biochemical Society Transactions, 2000, vol. 28, pp. 658-660.

Sato, S., et al., "Production of γ-Linolenic Acid and Stearidonic Acid in Seeds of Marker-Free Transgenic Soybean", Crop Science, 2004, vol. 44, pp. 646-652.

Inagaki, K., et al., "Identification and Expression of a Rat Fatty Acid Elongase Involved in the Biosynthesis of C18 Fatty Acids", Biosci. Biotechnol. Biochem., 2002, vol. 66, No. 3, pp. 613-621.

Wallis, J. G., et al., "The $\Delta^8$-Desaturase of Euglena gracilis: An Alternate Pathway for Synthesis of 20-Carbon Polyunsaturated Fatty Acids", Archives of Biochemistry and Biophysics, 1999, vol. 365, No. 2, pp. 307-316.

Qi, B., et al., "Identification of a cDNA Encoding a Novel C18-$\Delta^9$ Polyunsaturated Fatty Acid-Specific Elongating Activity From the Docosahexaenoic Acid (DHA)-Producing Microalga, Isochrysis galbana", FEBS Letters, 2002, vol. 510, pp. 159-165.

Qi, B. et al., "Production of Very Long Chain Polyunsaturated Omega-3 and Omega-6 Fatty Acids in Plants", Nature Biotechnology, 2004, vol. 22, No. 6, pp. 739-745.

Knutzon, D. S., et al., "Identification of $\Delta5$-Desaturase from Mortierella alpina by Heterologous Expression in Bakers' Yeast and Canola", The Journal of Biological Chemistry, 1998, vol. 273, No. 45, pp. 29360-29366.

Leonard, A. E., et al., "cDNA Cloning and Characterization of Human $\Delta^5$-Desaturase Involved in the Biosynthesis of Arachidonic Acid", Biochem. J., 2000, vol. 347, pp. 719-724.

Hong, H., et al., "Isolation and Characterization of a $\Delta5$ FA Desaturase from Pythium irregulare by Heterologous Expression in Saccharomyces cerevisiae and Oilseed Crops", Lipids, 2002, vol. 37, No. 9, pp. 863-868.

Leonard, A. E., et al., "Cloning of a Human cDNA Encoding a Novel Enzyme Involved in the Elongation of Long-Chain Polyunsaturated Fatty Acids", Biochem. J., 2000, vol. 350, pp. 765-770.

Leonard, A. E., et al., "Identification and Expression of Mammalian Long-Chain PUFA Elongation Enzymes", Lipids, 2002, vol. 37, No. 8, pp. 733-740.

Agaba, M., et al., "Zebrafish cDNA Encoding Multifunctional Fatty Acid Elongase Involved in Production of Eicosapentaenoic (20:5n-3) and Docosahexaenoic (22:6n-3) Acids", Marine Biotechnology, 2004, vol. 6, pp. 251-261.

Armbrust, E. V., et al., "The Genome of the Diatom Thalassiosira pseudonana: Ecology, Evolution, and Metabolism", Science, 2004, vol. 306, pp. 79-86.

Clough, S. J., et al., "Floral Dip: A Simplified Method for Agrobacterium-Mediated Transformation of Arabidopsis thaliana", The Plant Journal, 1998, vol. 16, No. 6, pp. 735-743.

Qiu, X., et al., "Identification of a $\Delta4$ Fatty Acid Desaturase from Thraustochytrium sp. Involved in the Biosynthesis of Docosahexanoic Acid by Heterologous Expression in Saccharomyces cerevisiae and Brassica juncea", The Journal of Biological Chemistry, 2001, vol. 276, No. 34, pp. 31561-31566.

Millar, A. A., et al., "Accumulation of Very-Long-Chain Fatty Acids in Membrane Glycerolipids Is Associated with Dramatic Alternations in Plant Morphology", The Plant Cell, 1998, vol. 11, pp. 1889-1902.

Robert, S. S., et al., "Metabolic Engineering of Arabidopsis to Produce Nutritionally Important DHA in Seed Oil", Functional Plant Biology, 2005, vol. 32, pp. 473-479.

Domergue, F., et al., "In Vivo Characterization of the First Acyl-CoA $\Delta^6$-Desaturase from a Member of the Plant Kingdom, the Microalga Ostreococcus tauri", Biochem. J., 2005, vol. 389, pp. 483-490.

Venegas-Calerón, M., et al., "An Alternative to Fish Oils: Metabolic Engineering of Oil-Seed Crops to Produce Omega-3 Long Chain Polyunsaturated Fatty Acids", Progress in Lipid Research, 2010, vol. 49, pp. 108-119.

Meyer, A., et al., "Biosynthesis of Docosahexaenoic Acid in Euglena gracilis: Biochemical and Molecular Evidence for the Involvement of a $\Delta4$-Fatty Acyl Group Desaturase", Biochemistry, 2003, vol. 42, pp. 9779-9788.

Wagner, et al., "Generation of glycerophospholipid molecular species in the yeast Saccharomyces cerevisiae. Fatty acid pattern of phospholipid classes and selective acyl turnover at sn-1 and sn-2 positions", Yeast, vol. 10, 1994, pp. 1429-1437.

Diedrich, et al., "The natural occurrence of unusual fatty acids. Part 1. Odd numbered fatty acids", Molecular Nutrition & Food Research, vol. 34, Issue 10, 1990, pp. 935-943.

"Codex Standard for Named Vegetable Oils—CX-STAN 210-1999", excerpt from Codex Alimentarius, 2001, vol. 8, pp. 11-25.

"Danio rerio Polyunsaturated Fatty Acid Elongase mRNA, Complete cds", Database GenBank, Accession No. AF532782, Feb. 15, 2006.

"Phaeodactylum tricornutum Delta 12 Fatty Acid Desaturase mRNA, Complete cds; Nuclear Gene for Microsomal Protein", Database GenBank, Accession No. AY165023, Apr. 14, 2003.

Girke, T., et al., "Identification of a Novel $\Delta6$-Acyl-Group Desaturase by Targeted Gene Disruption in Physcomitrella patens", The Plant Journal, 1998, vol. 15, No. 1, pp. 39-48.

Michaelson, L. V., et al., "Functional Identification of a Fatty Acid $\Delta^5$ Desaturase Gene from Caenorhabditis elegans", FEBS Letters, 1998, vol. 439, No. 3, pp. 215-218.

Michaelson, L. V., et al., "Isolation of a $\Delta^5$-Fatty Acid Desaturase Gene from Mortierella alpina", The Journal of Biological Chemistry, 1998, vol. 273, No. 30, pp. 19055-19059.

Moon, Y.-A., et al., "Identification of a Mammalian Long Chain Fatty Acyl Elongase Regulated by Sterol Regulatory Element-Binding Proteins", The Journal of Biological Chemistry, 2001, vol. 276, No. 48, pp. 45358-45366.

Sayanova, et al., "Expression of a Borage Desaturase cDNA Containing an N-Terminal Cytochrome b5 Domain Results in the Accumulation of High Levels of $\Delta^6$-Desaturated Fatty Acids in Transgenic Tobacco", Proc. Natl. Acad. Sci USA, 1997, vol. 94, pp. 4211-4216.

"Future Considerations", p. 221 of "Bailey's Industrial Oil and Fat Products", Sixth Edition, vol. 6, Shahidi, F., Ed., John Wiley & Sons, Inc., 2005.

(56) References Cited

OTHER PUBLICATIONS

Sperling, P., et al., "A Bifunctional $\Delta^6$-Fatty Acyl Acetylenase/Desaturase from the Moss *Ceratodon purpureus*", European Journal of Biochemistry, 2000, vol. 267, No. 12, pp. 3801-3811.

Tonon, T., et al., "Identification of a Very Long Chain Polyunsaturated Fatty Acid $\Delta4$-Desaturase from the Microalga *Pavlova lutheri*", FEBS letters, 2003, vol. 553, No. 3, pp. 440-444.

Watts, J. L., et al., "Isolation and Characterization of a$\Delta^5$-Fatty Acid Desaturase from *Caenorhabditis elegans*", Archives of Biochemistry and Biophysics, 1999, vol. 362, No. 1, pp. 175-182.

Kang, Z. B., et al., "Adenoviral Gene Transfer of *Caenorhabditis elegans* n-3 Fatty Acid Desaturase Optimizes Fatty Acid Composition in Mammalian Cells", PNAS, 2001, vol. 98, No. 7, pp. 4050-4054.

Qi B. et al., "Production of Very Long Chain Polyunsaturated Omega-3 and Omega-6 Fatty Acids in Plants", Nature Biotechnology, 2004, vol. 22, No. 6, pp. 739-745.

Robert, S. S., Production of Eicosapentaenoic and Docosahexaenoic Acid-Containing Oils in Transgenic Land Plants for Human and Aquaculture Nutrition, Marine Biotechnology, 2006, 8: 103-109.

Stirn, S., et al., "Genetically Modified Plants", Chapter 2 in "Genetically Engineered Food: Methods and Detection", Heller, K. J., Ed., Wiley-VCH Verlag GmbH & Co. KGaA, Weinheim, Germany, Published Online Jan. 7, 2005, pp. 26-61.

"Danio rerio Polyunsaturated Fatty Acid Elongase Protein", GenBank Database Accession No. AAN77156, Feb. 15, 2006.

Yu, Z., et al., "Study on Nutritional Function of Polyunsaturated Fatty Acid", China Feed, 2003, Issue 24, pp. 21-23.

\* cited by examiner

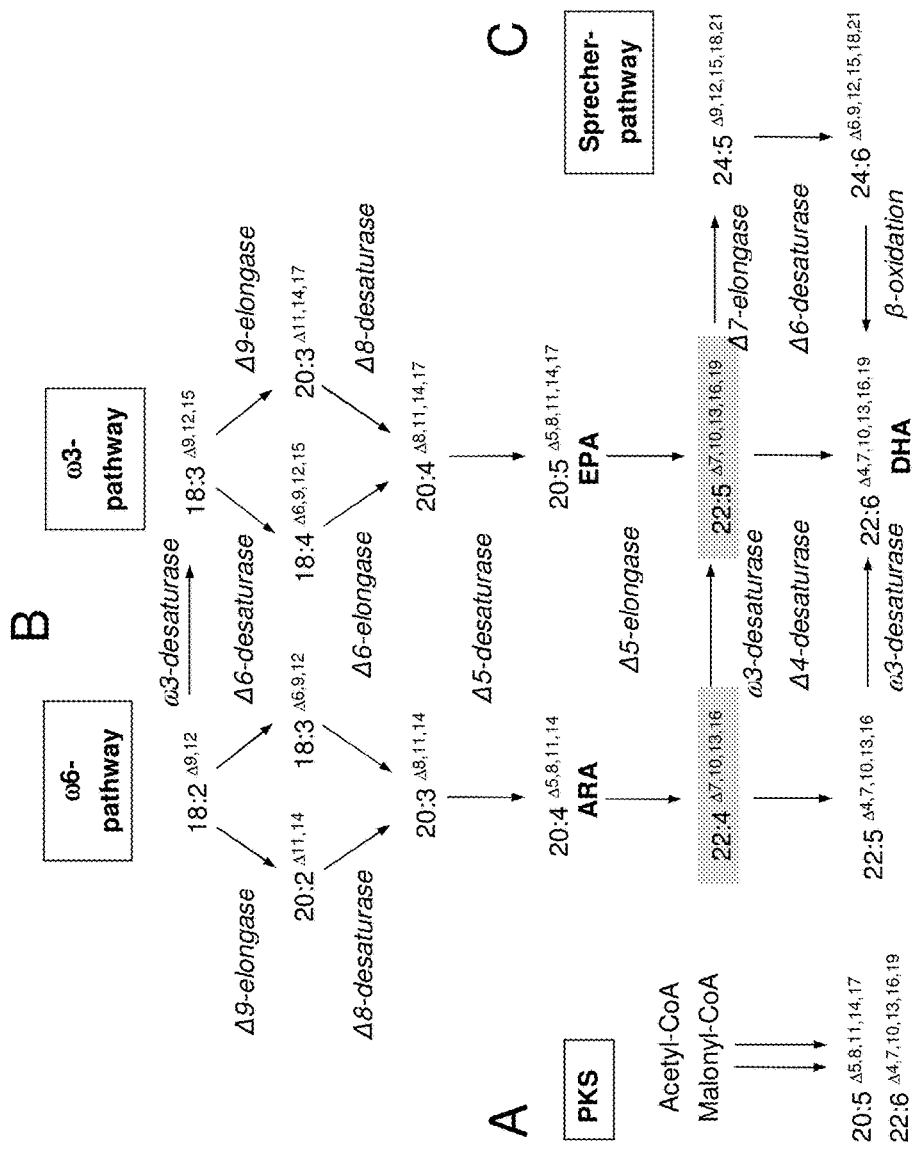
Figure 1: Various synthetic pathways for the biosynthesis of DHA (docosahexaenoic acid)

Figure 2: Substrate specificity of the Δ5-elongase (SEQ ID NO: 53) with regard to different fatty acids
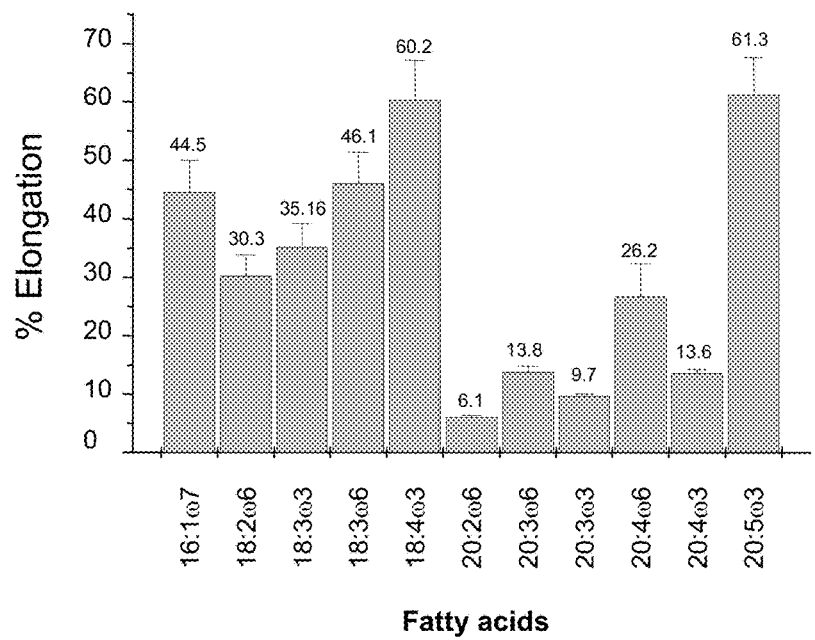

Figure 3: Reconstitution of DHA biosynthesis in yeast starting from 20:5ω3.
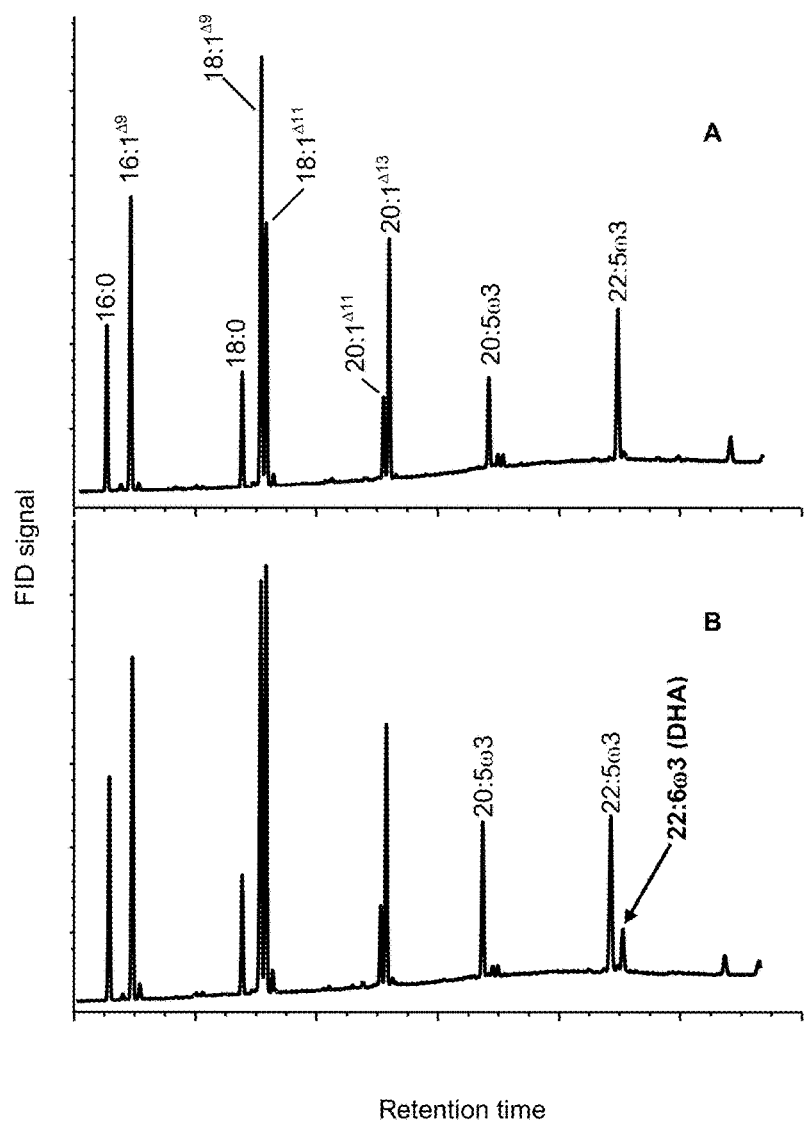

Figure 4: Reconstitution of DHA biosynthesis in yeast starting from 18:4ω3.
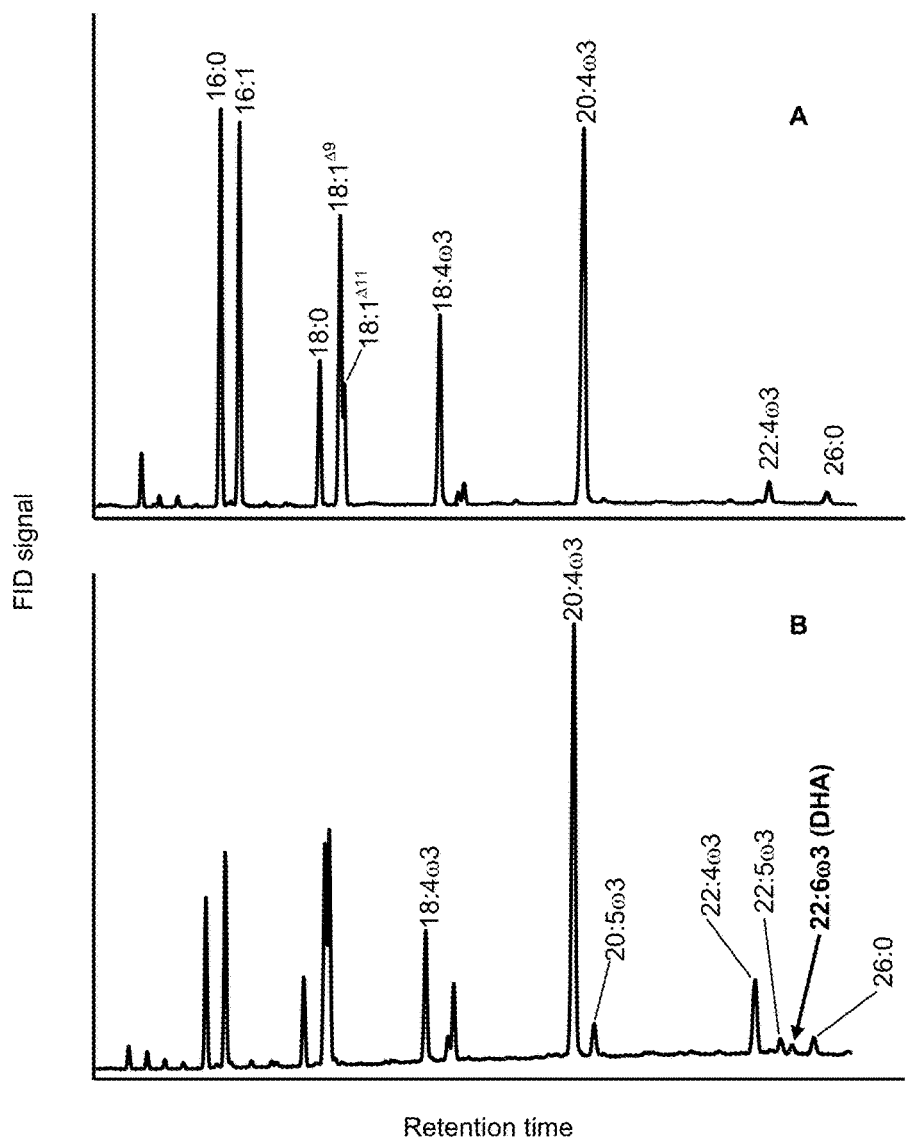

Figure 5: Fatty acid composition (in mol%) of transgenic yeasts which had been transformed with the vectors pYes3-OmELO3/pYes2-EgD4 or pYes3-OmELO3/pYes2-EgD4+pESCLeu-PtD5. The yeast cells were cultured in minimal medium without tryptophan and uracil/ and leucin in the presence of 250 μM $20:5^{\Delta5,8,11,14,17}$ and $18:4^{\Delta6,9,12,15}$, respectively. The fatty acid methyl esters were obtained from cell sediments by acid methanolysis and analyzed via GLC. Each value represents the mean (n=4) ± standard deviation.

| Fatty acids | pYes3-OmELO/pYes2-EgD4 Feeding of $20:5^{\Delta5,8,11,14,17}$ | pYes3-OmELO/pYes2-EgD4 EgD4 + pESCLeu-PtD5 Feeding of $18:4^{\Delta6,9,12,15}$ |
|---|---|---|
| 16:0 | 9.35 ± 1.61 | 7.35 ± 1.37 |
| $16:1^{\Delta9}$ | 14.70 ± 2.72 | 10.02 ± 1.81 |
| 18:0 | 5.11 ± 1.09 | 4.27 ± 1.21 |
| $18:1^{\Delta9}$ | 19.49 ± 3.01 | 10.81 ± 1.95 |
| $18:1^{\Delta11}$ | 18.93 ± 2.71 | 11.61 ± 1.48 |
| $18:4^{\Delta6,9,12,15}$ | - | 7.79 ± 1.29 |
| $20:1^{\Delta11}$ | 3.24 ± 0.41 | 1.56 ± 0.23 |
| $20:1^{\Delta13}$ | 11.13 ± 2.07 | 4.40 ± 0.78 |
| $20:4^{\Delta8,11,14,17}$ | - | 30.05 ± 3.16 |
| $20:5^{\Delta5,8,11,14,17}$ | 6.91 ± 1.10 | 3.72 ± 0.59 |
| $22:4^{\Delta10,13,16,17}$ | - | 5.71 ± 1.30 |
| $22:5^{\Delta7,10,13,16,19}$ | 8.77 ± 1.32 | 1.10 ± 0.27 |
| $22:6^{\Delta4,7,10,13,16,19}$ | 2.73 ± 0.39 | 0.58 ± 0.10 |

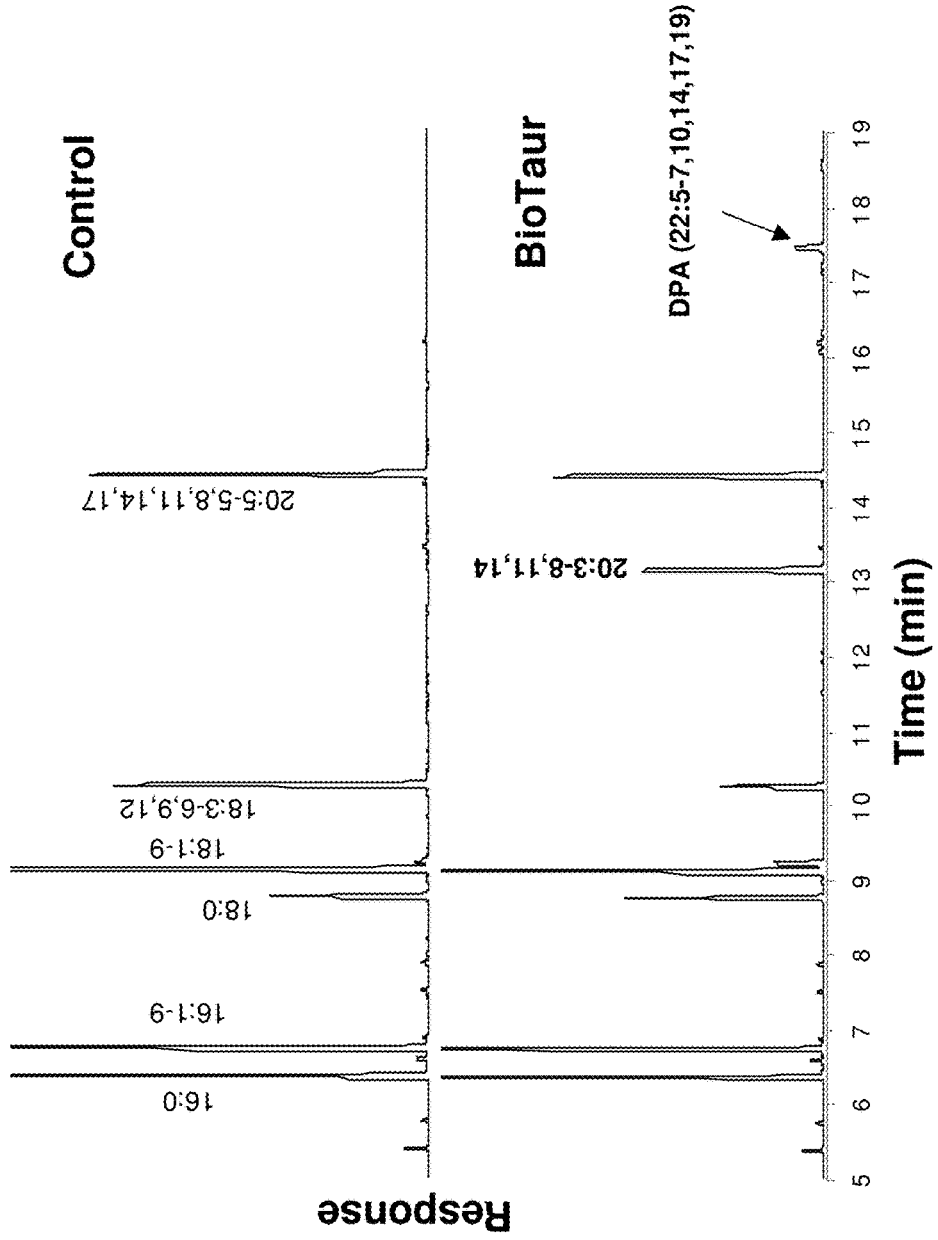
Figure 6: Feeding experiment for determining the functionality and substrate specificity with yeast strains

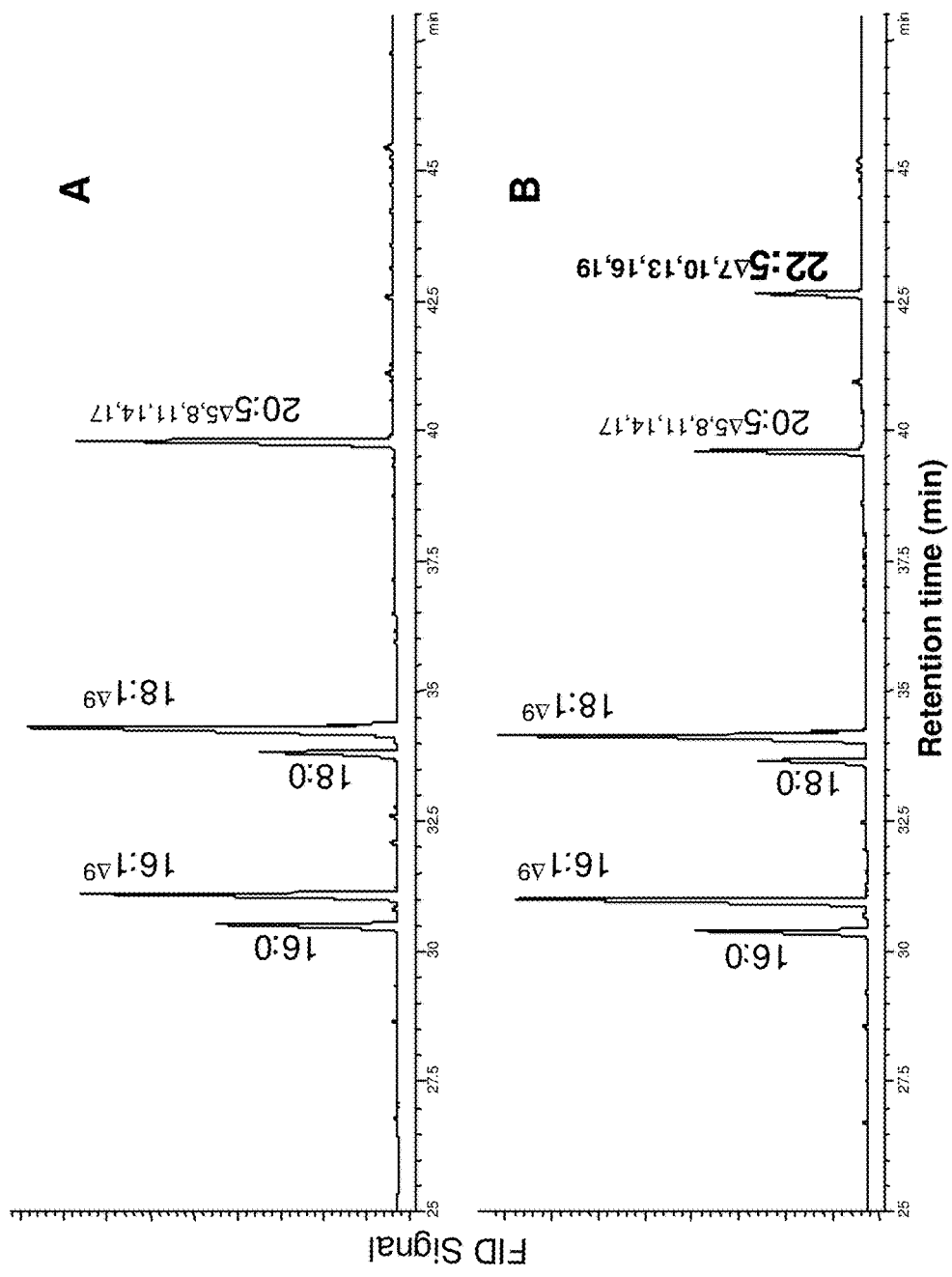
Figure 7: Elongation of eicosapentaenoic acid by OtElo1

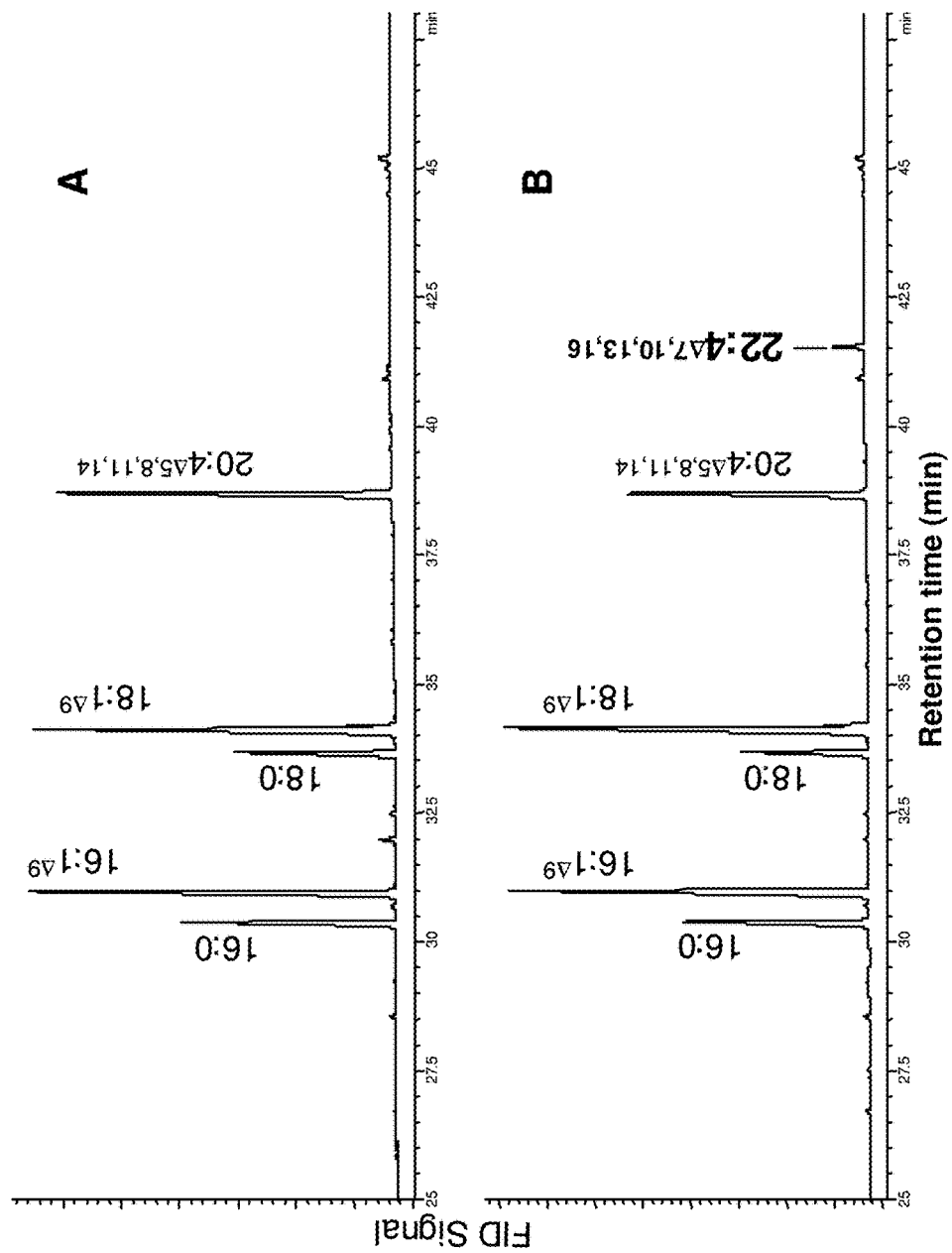
Figure 8: Elongation of arachidonic acid by OtElo1

Figure 9: Expression of TpELO1 in yeast
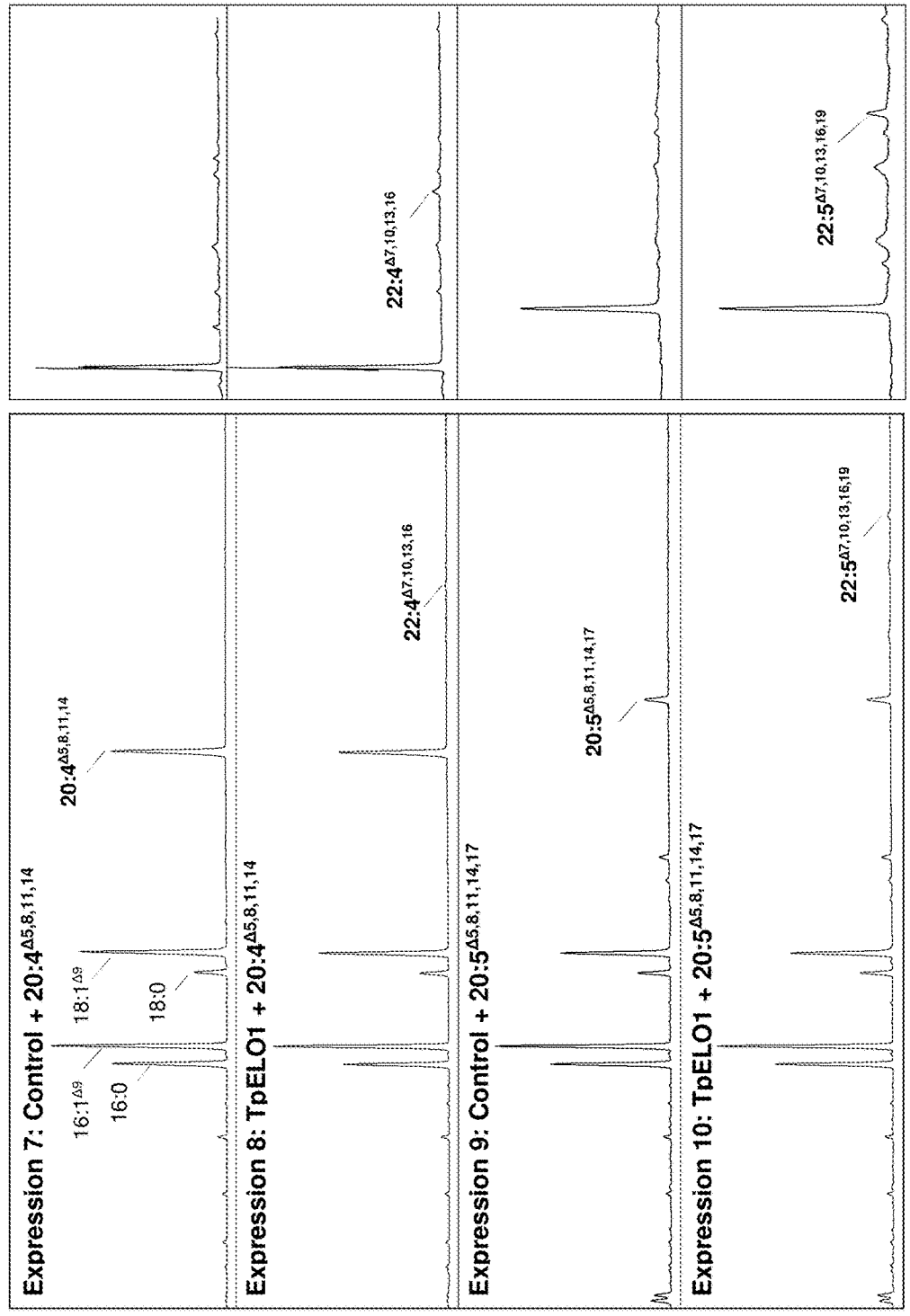

Figure 10: Expression of TpELO3 in yeast
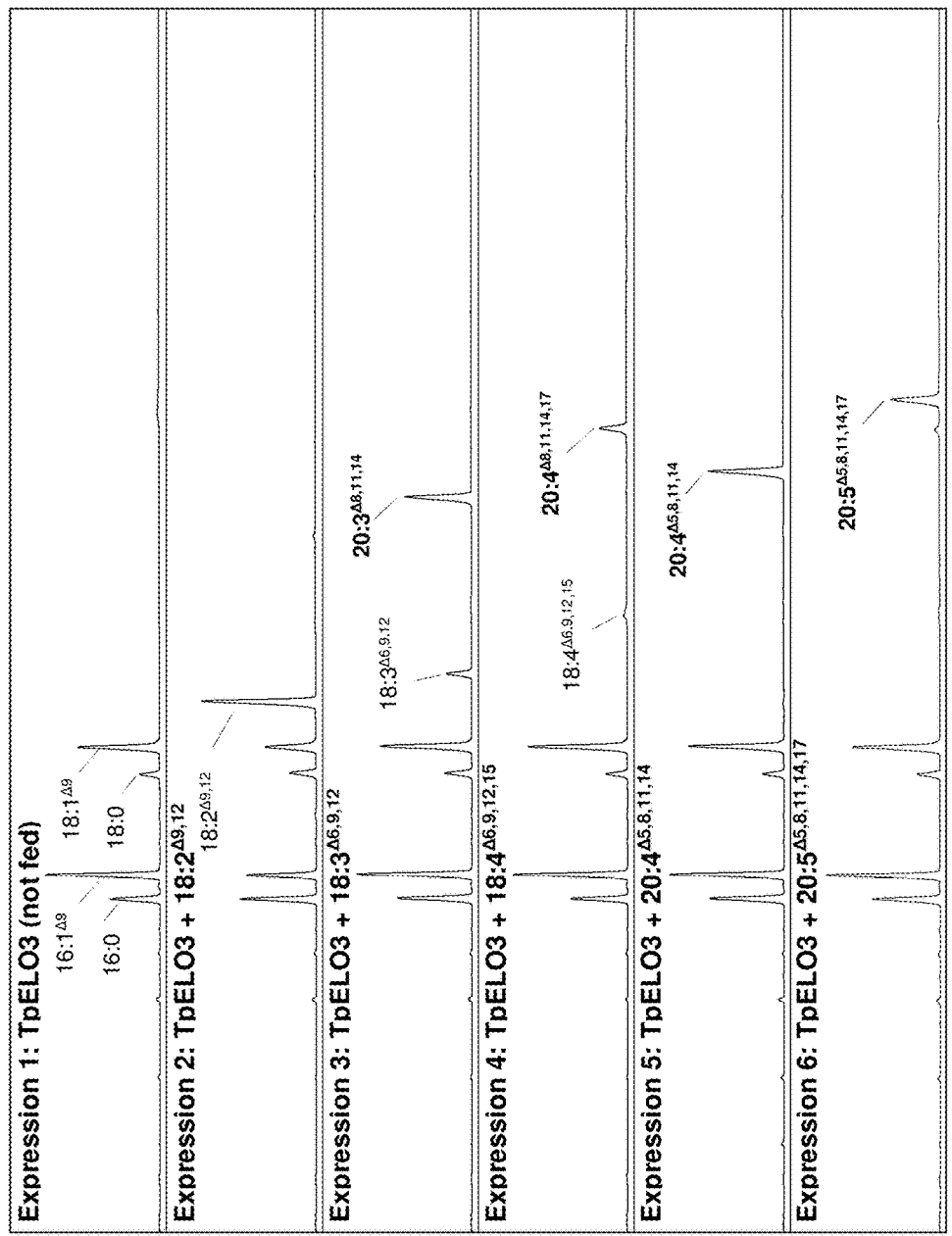

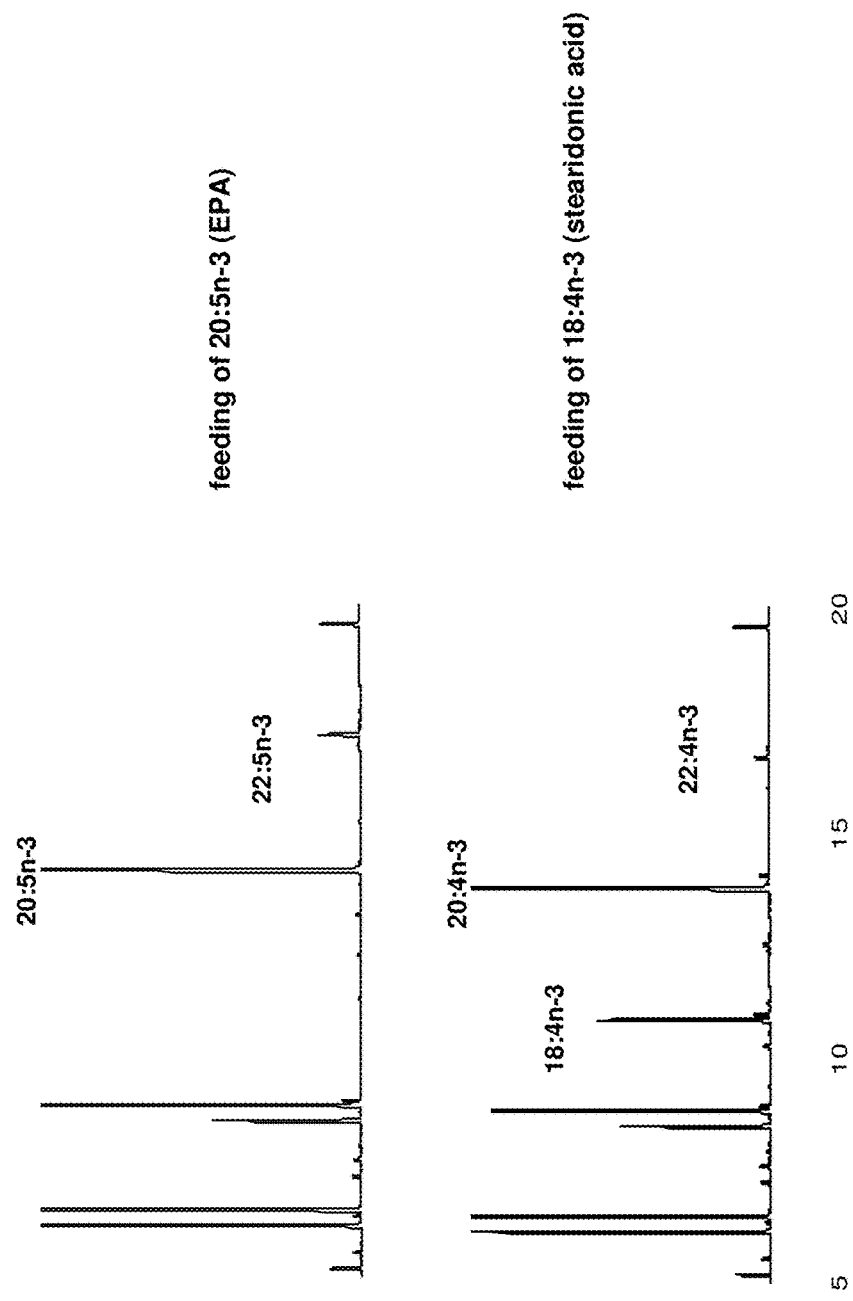
Figure 11: Expression of Thraustochytrium Δ5-elongase TL16/pYES2.1 in yeast Figure 12: Desaturation of γ-linolenic acid (18:2 ω6-fatty acid) to give α-linolenic acid (18:3 ω3-fatty acid) by Pi-omega3Des.
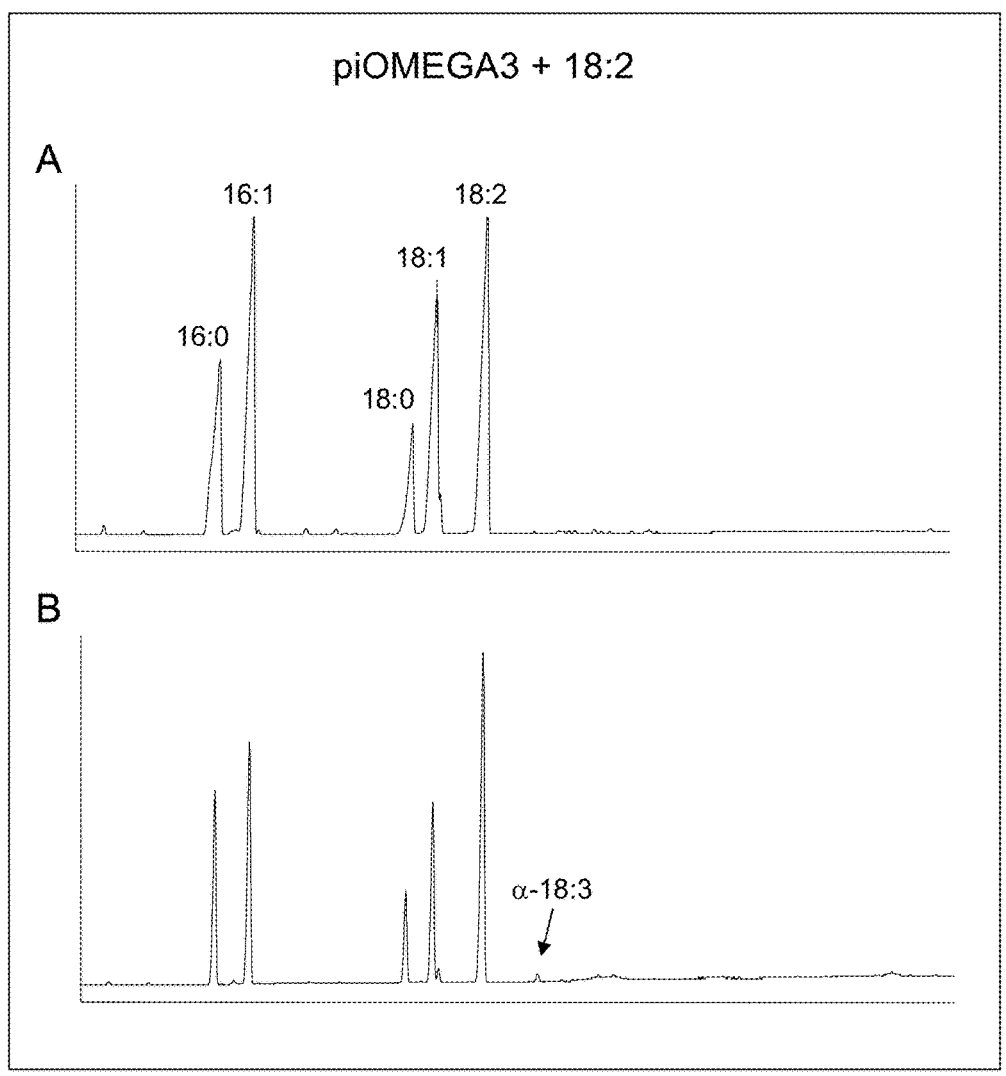

Figure 13: Desaturation of γ-linolenic acid (18:2 ω6-fatty acid) to give stearidonic acid (18:4 ω3-fatty acid) by Pi-omega3Des.
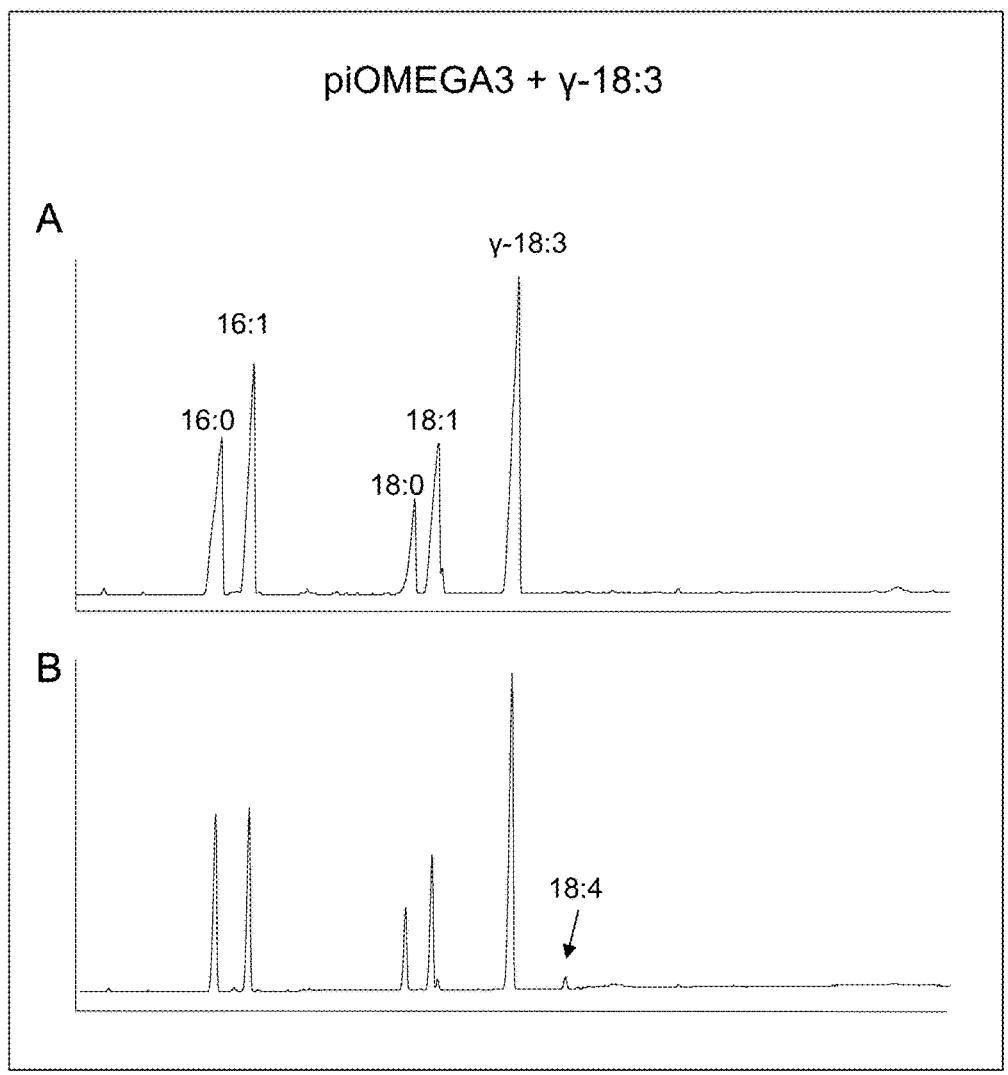

Figure 14: Desaturation of C20:2 ω6-fatty acid to give C20:3 ω3-fatty acid by Pi-omega3Des.
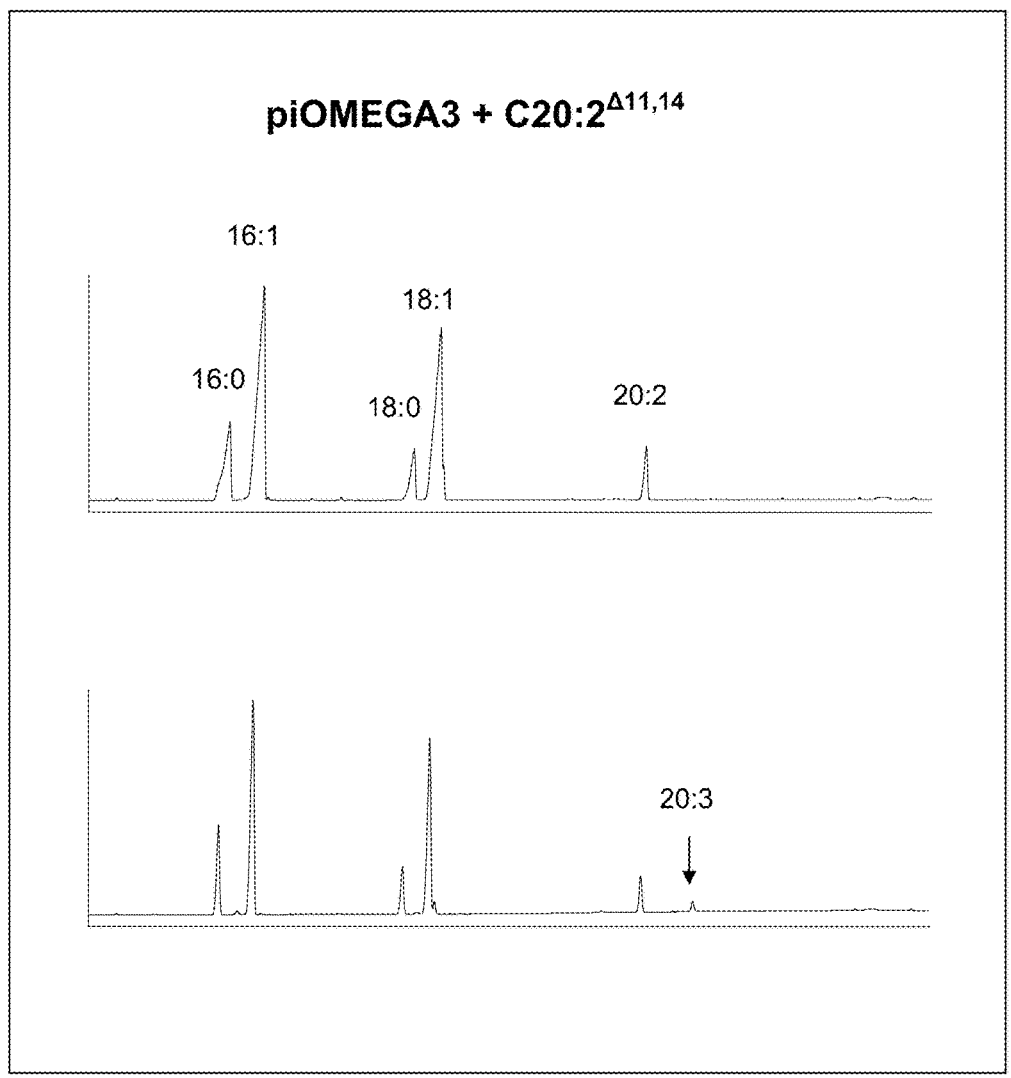

Figure 15: Desaturation of C20:3 ω6-fatty acid to give C20:4 ω3-fatty acid by Pi-omega3Des.
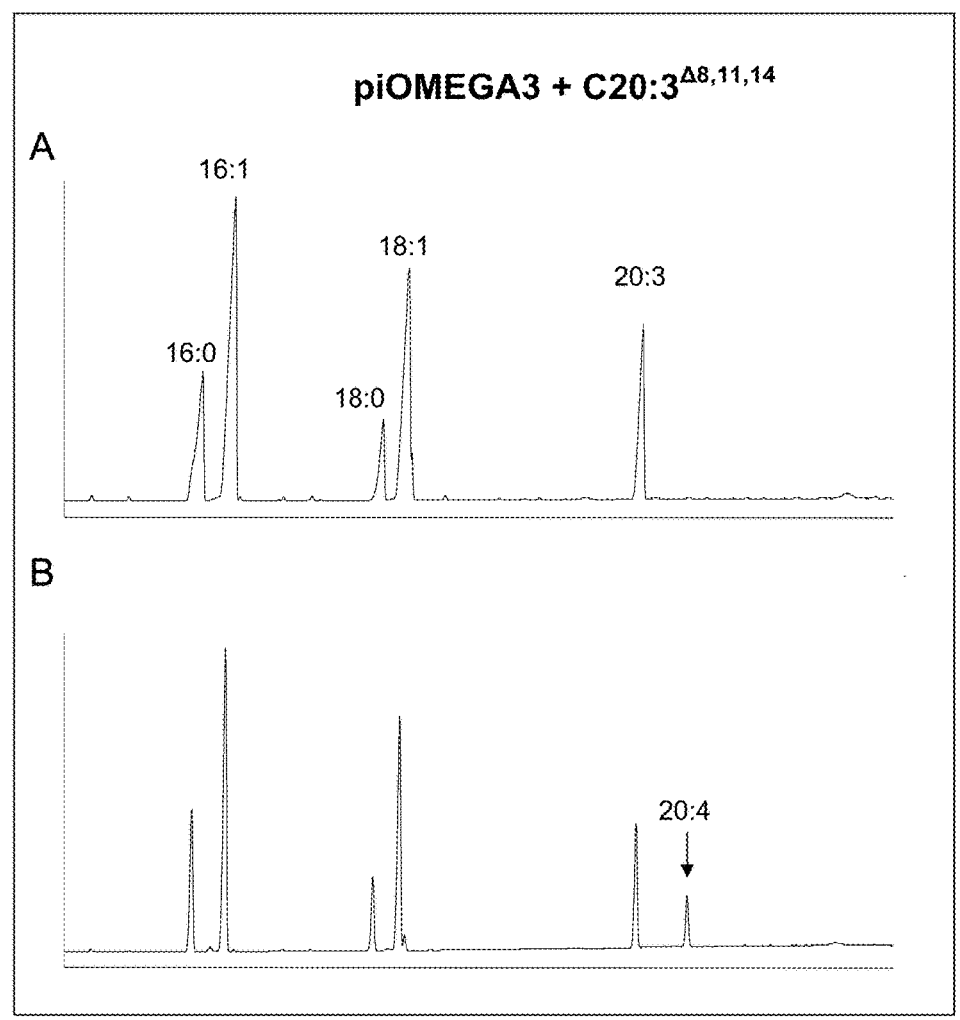

Figure 16: Desaturation of arachidonic acid (C20:4 ω6-fatty acid) to give eicosapentaenoic acid (C20:5 ω3-fatty acid) by Pi-omega3Des.
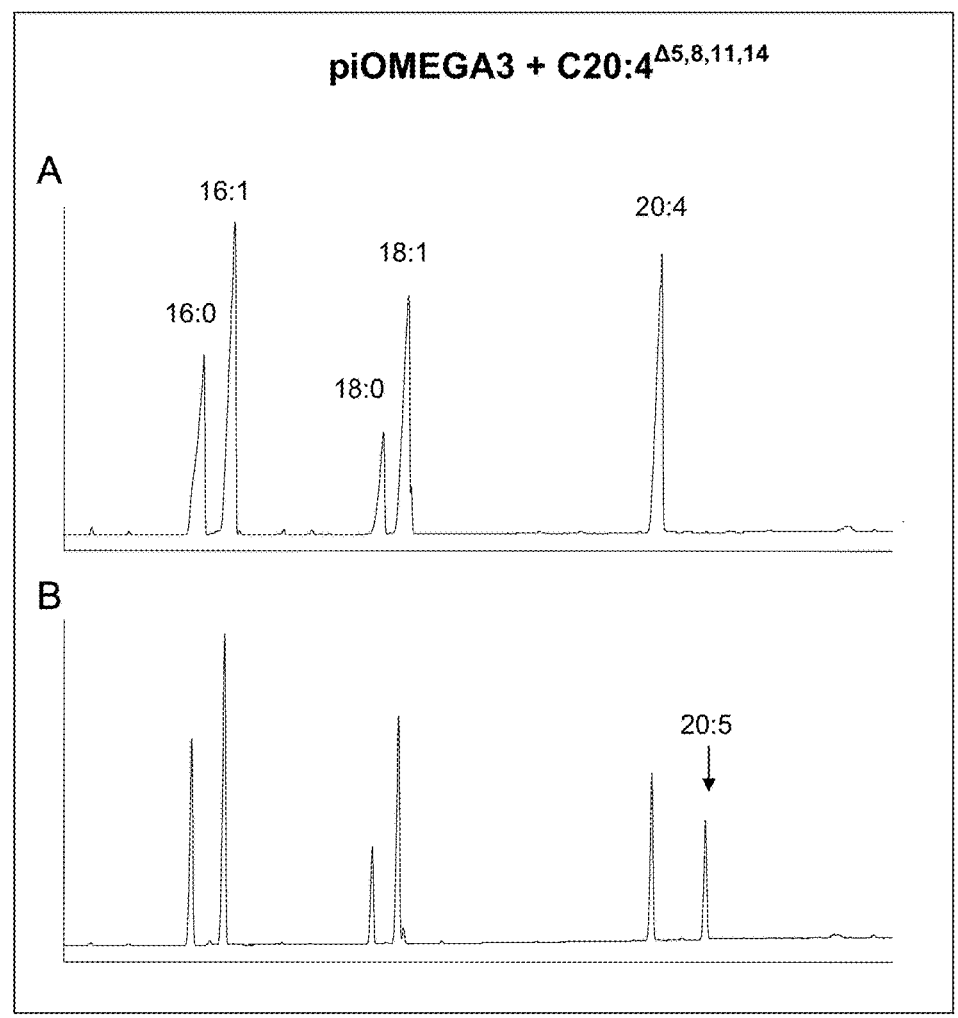

Figure 17: Desaturation of docosatetraenoic acid (C22:4 ω6-fatty acid) to give docosapentaenoic acid (C22:5 ω3-fatty acid) by Pi-omega3Des.
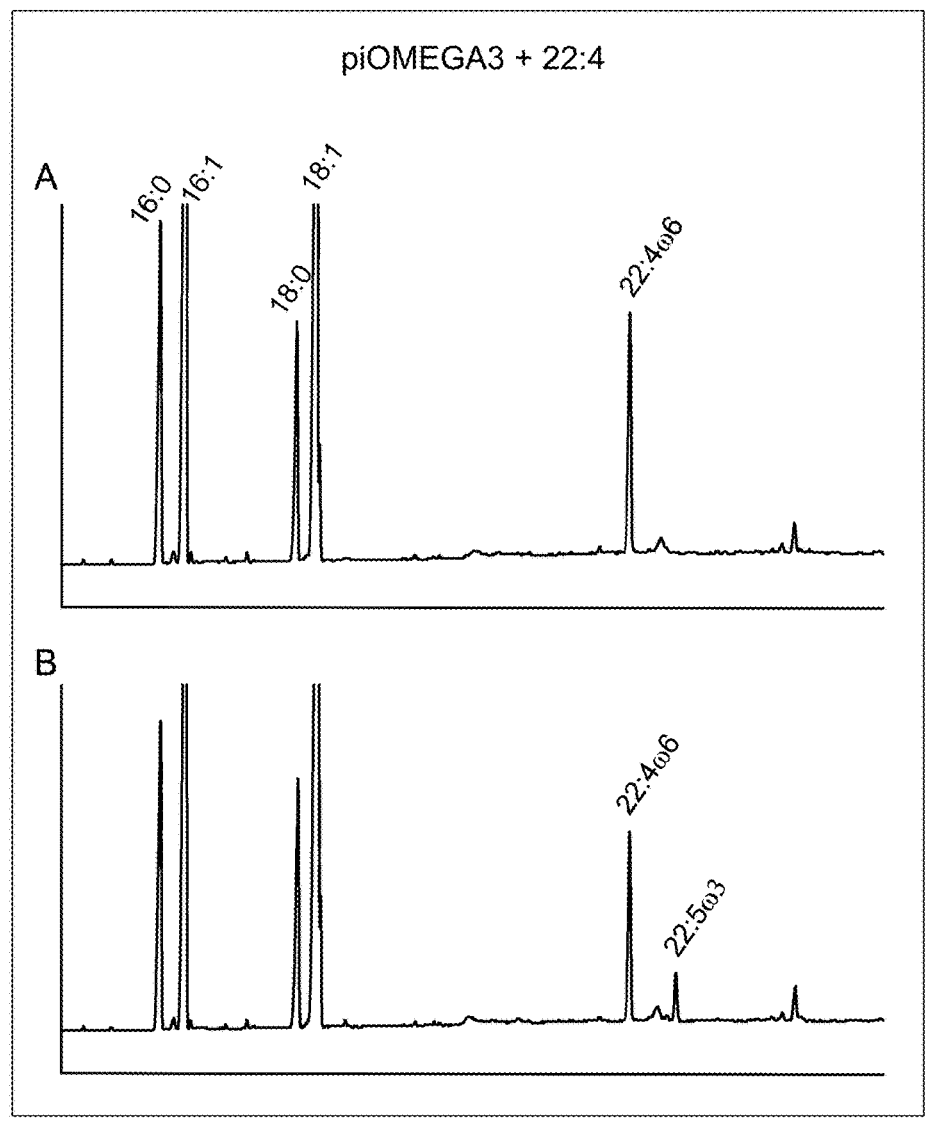

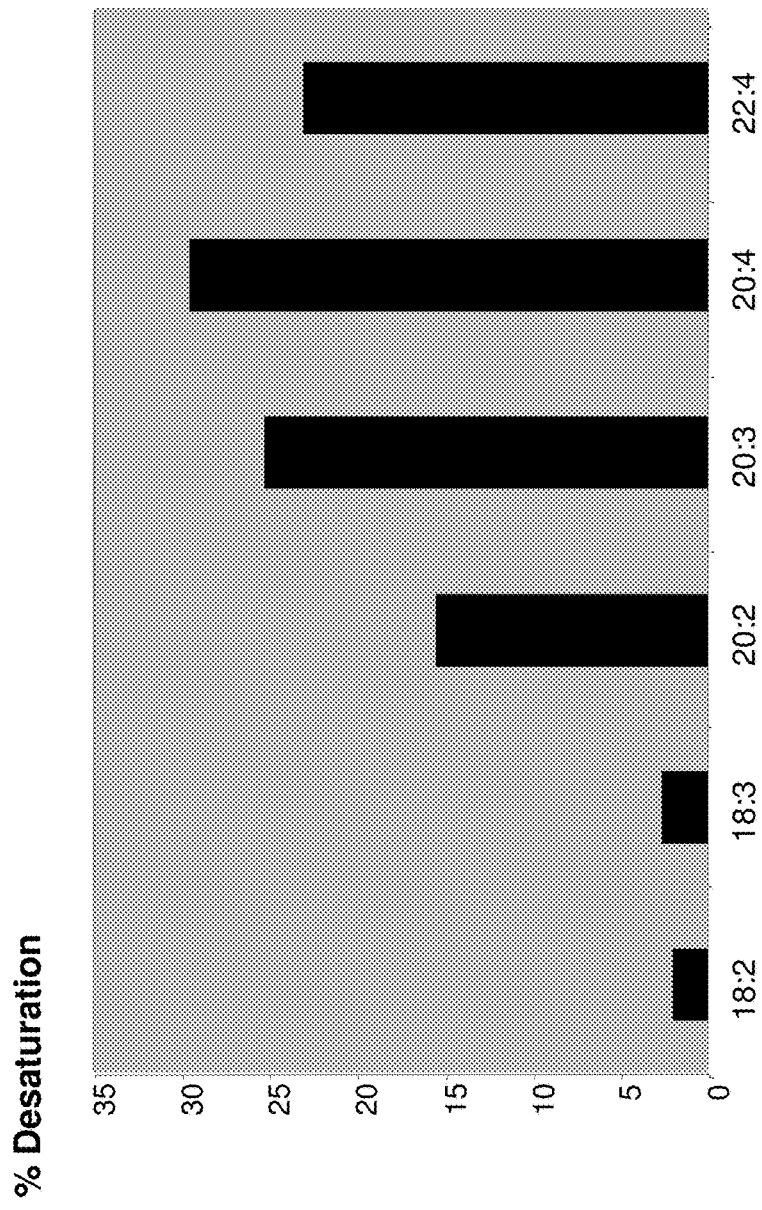
Figure 18: Substrate specificity of Pi-omega3Des with regard to different fatty acids

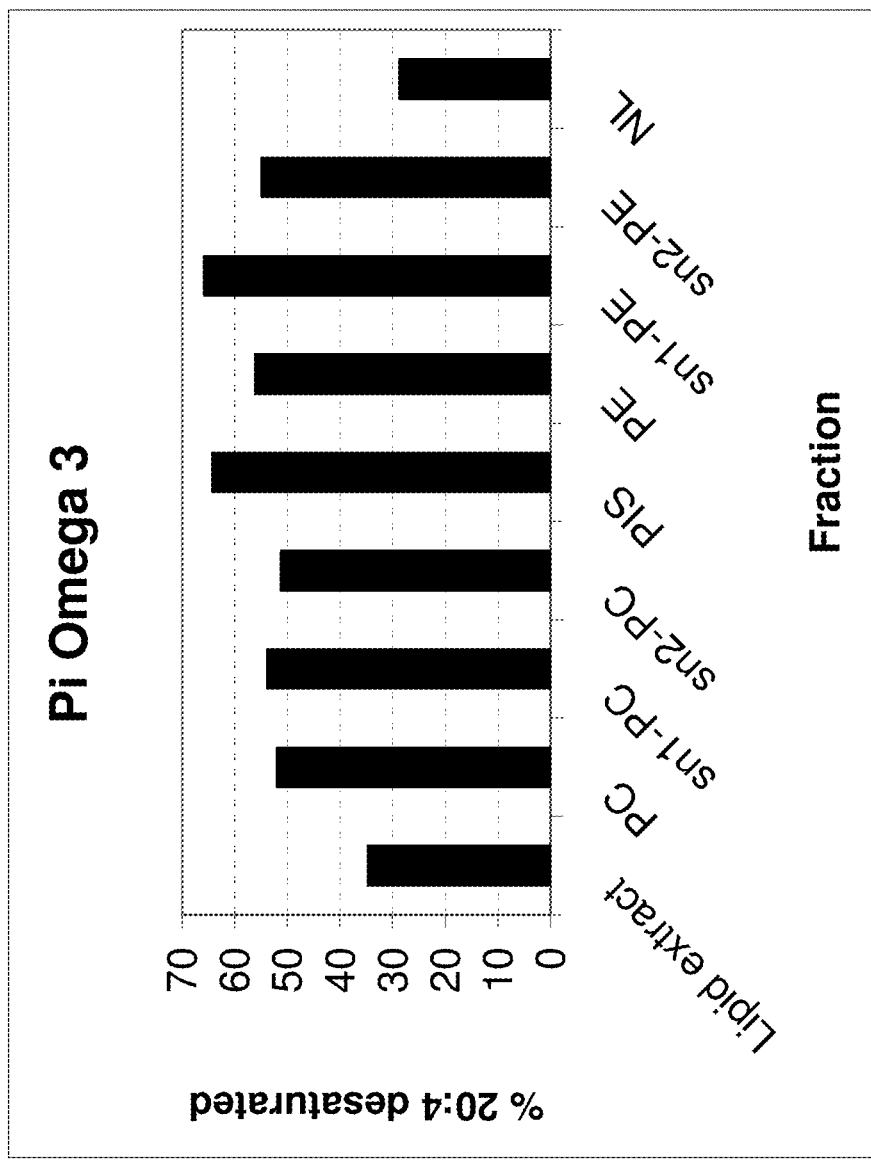
Figure 19: Desaturation of phospholipid-bound arachidonic acid to give EPA by Pi-Omega3Des Figure 20: Conversion of linoleic acid (arrow) to give γ-linolenic acid (γ-18:3) by OtDes6.1.
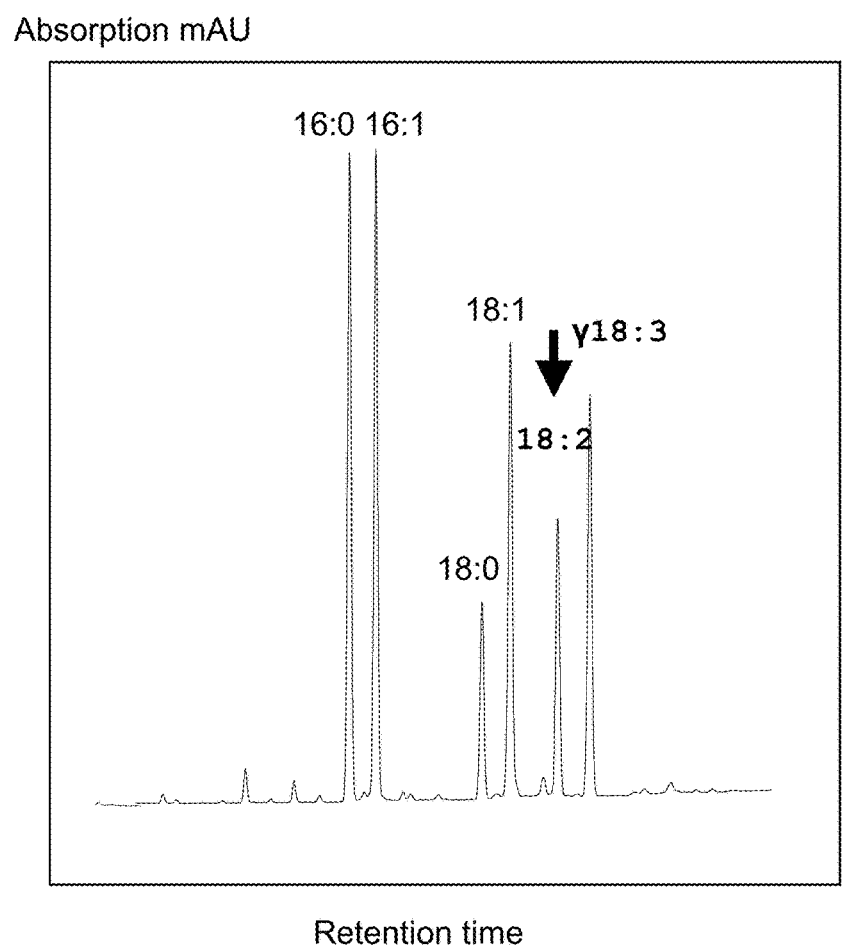

Figure 21: Conversion of linoleic acid and α-linolenic acid (A and C), and reconstitution of the ARA and EPA synthetic pathways, respectively, in yeast (B and D) in the presence of OtD6.1.
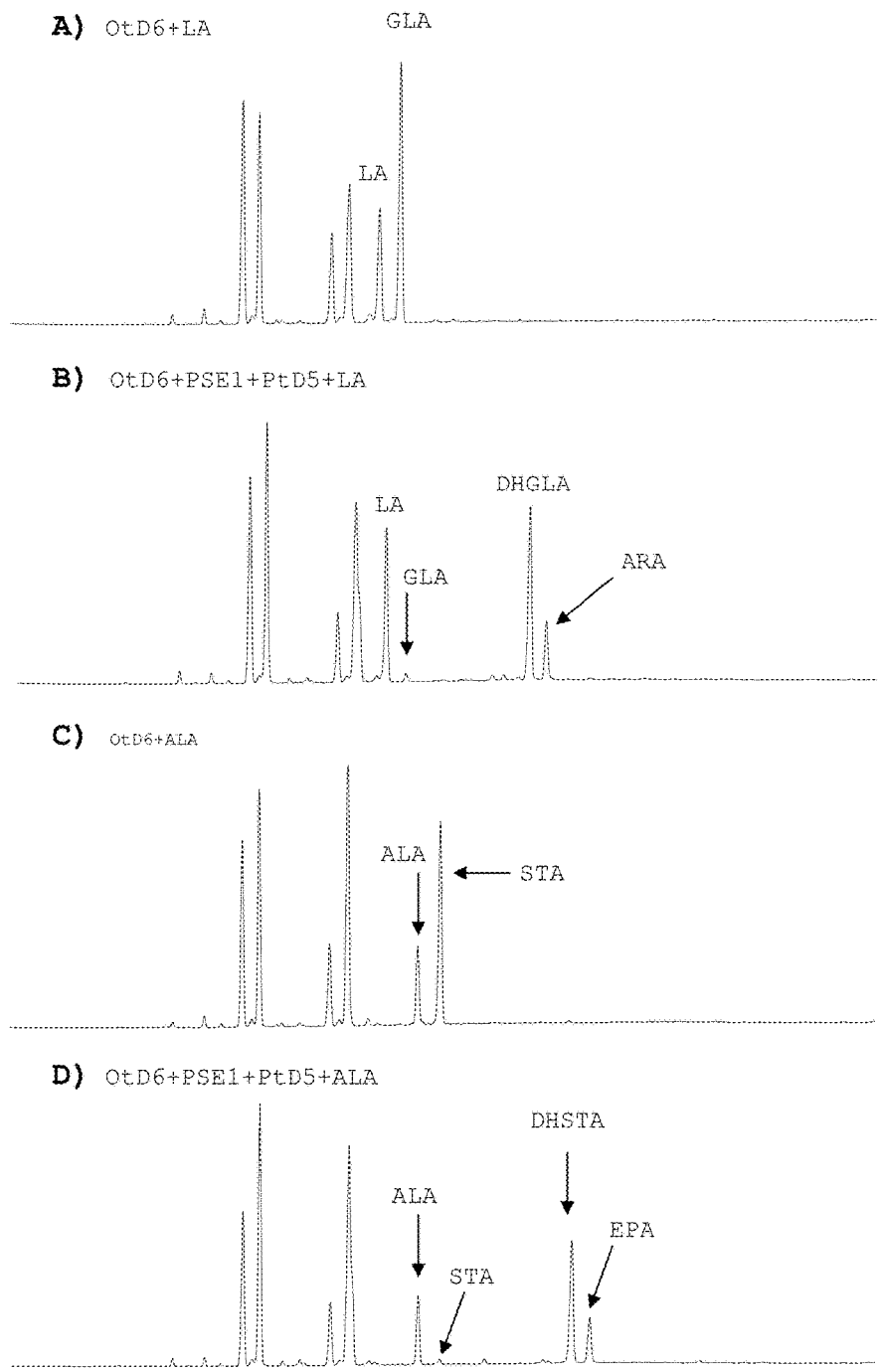

Figure 22: Expression of ELO(XI) in yeast
Absorption in mA
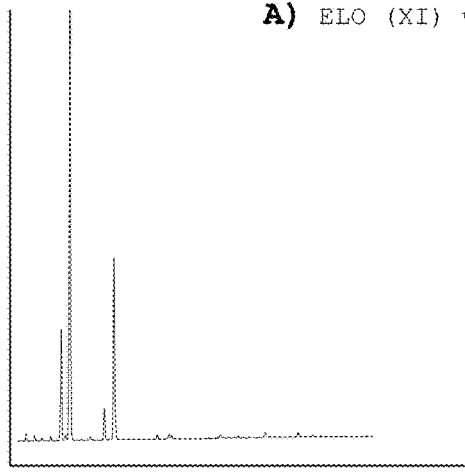
A) ELO (XI) without fatty acid
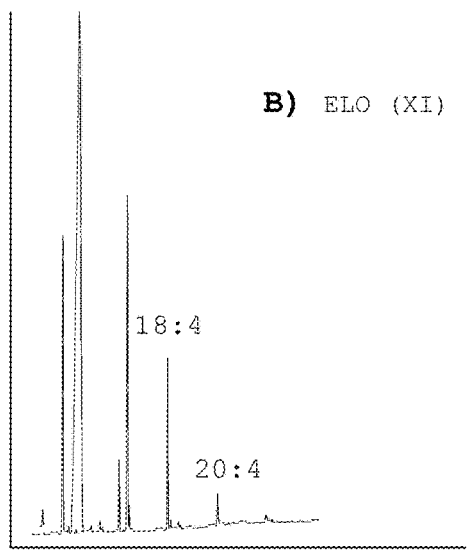
B) ELO (XI) + 18:4Δ6,9,12,15 (250
18:4
20:4
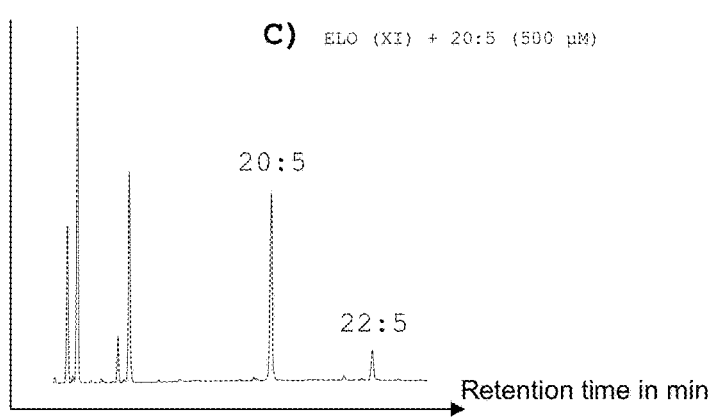
C) ELO (XI) + 20:5 (500 µM)
20:5
22:5
Retention time in min

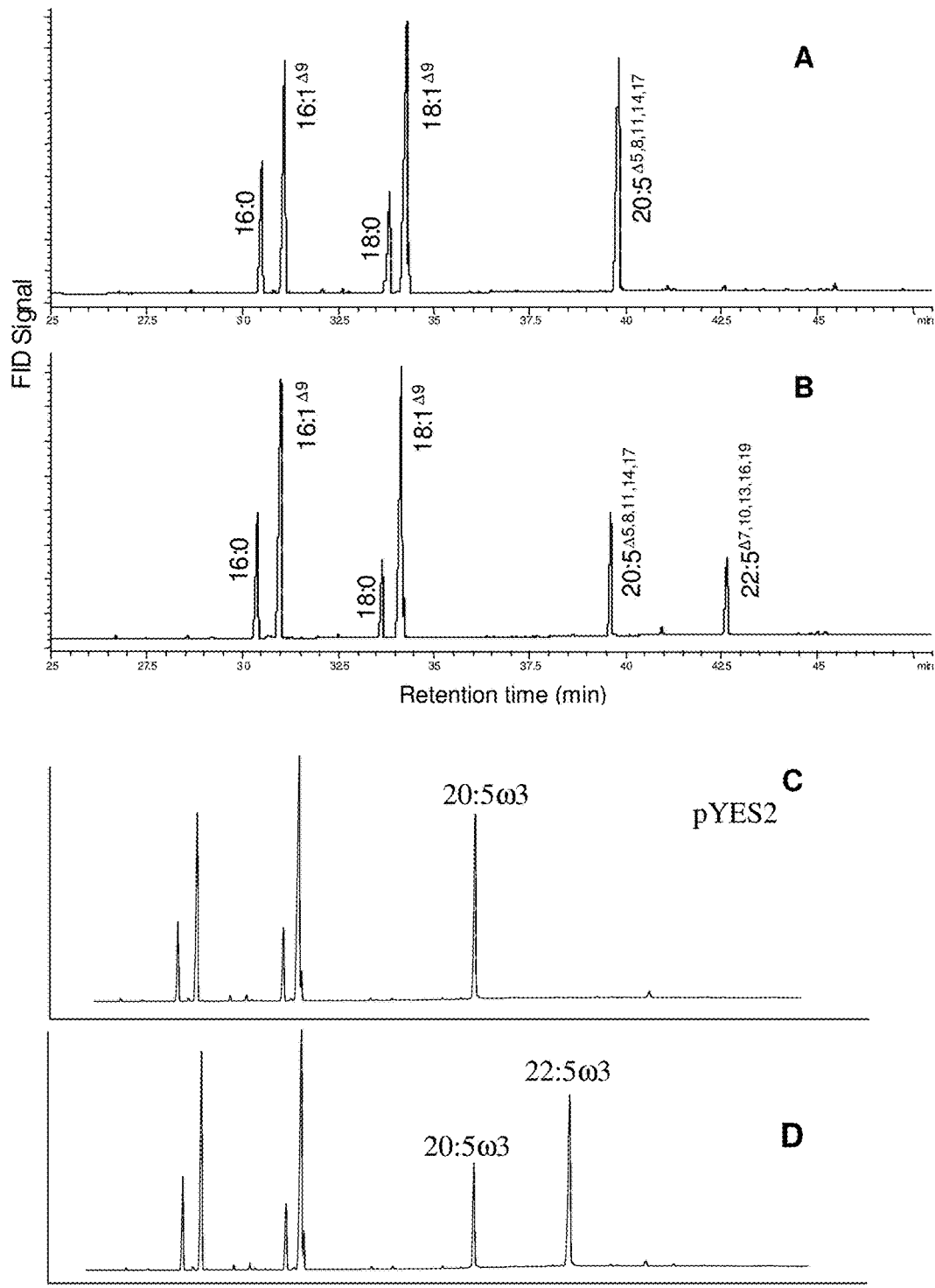
Figure 24: Elongation of eicosapentaenoic acid by OtElo1 (B) and OtElo1.2 (D), respectively. The controls (A, C) do not show the elongation product (22:5ω3).

Figure 25: Elongation of arachidonic acid by OtElo1 (B) and OtElo1.2 (D), respectively. The controls (A, C) do not show the elongation product (22:4ω6).
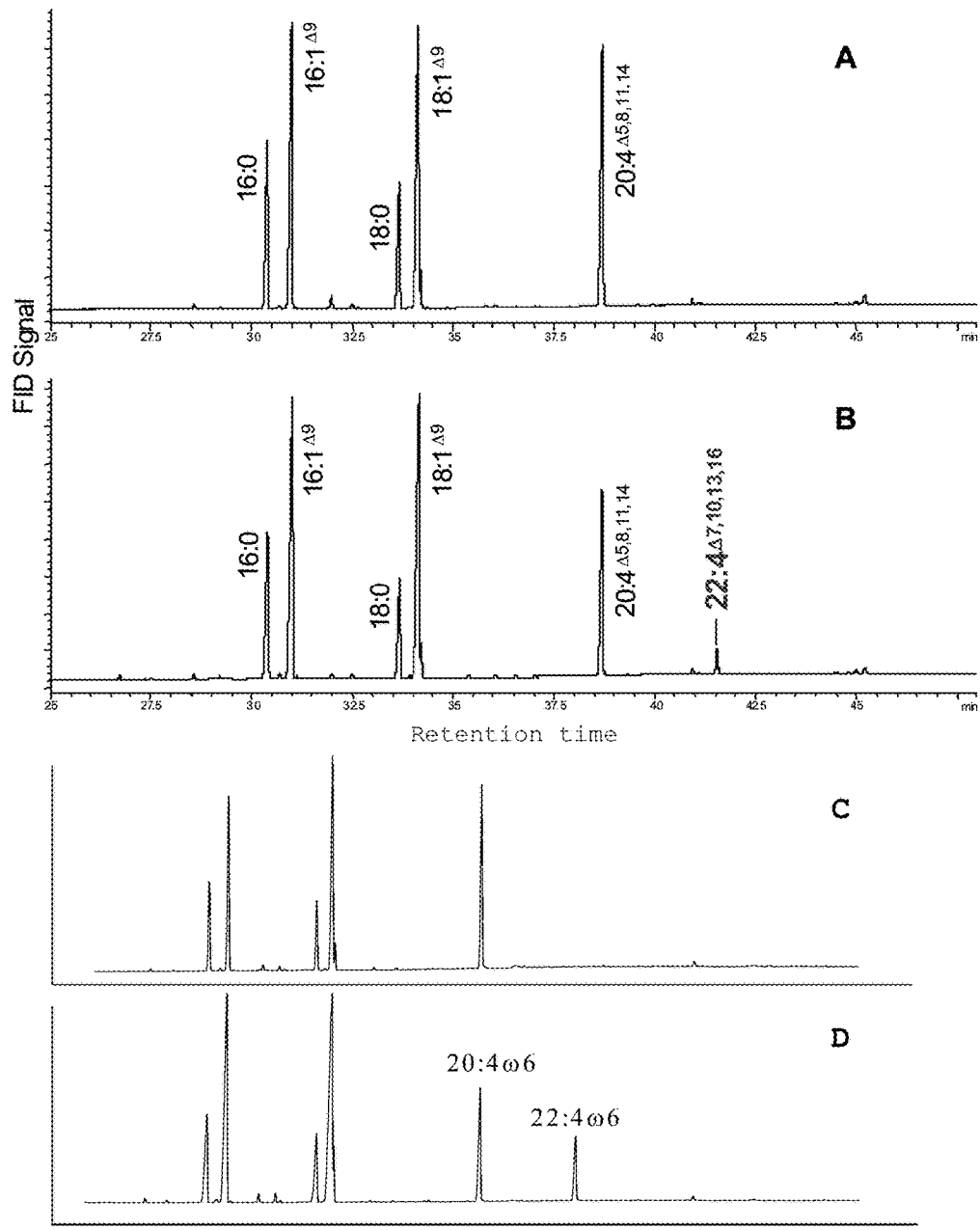

Figure 26: Elongation of 20:5n-3 by the elongases At3g06470.
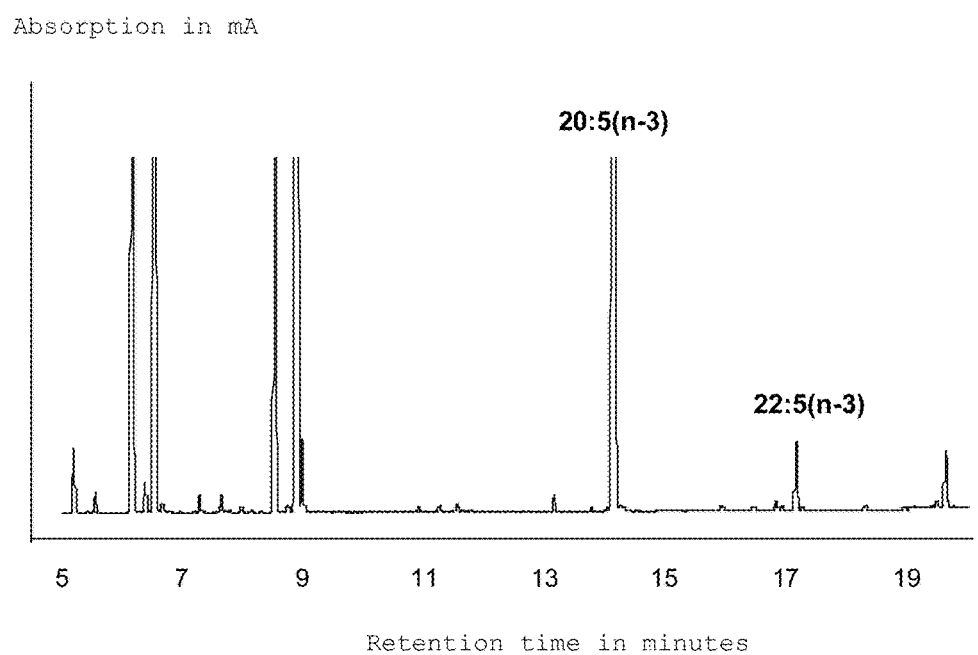

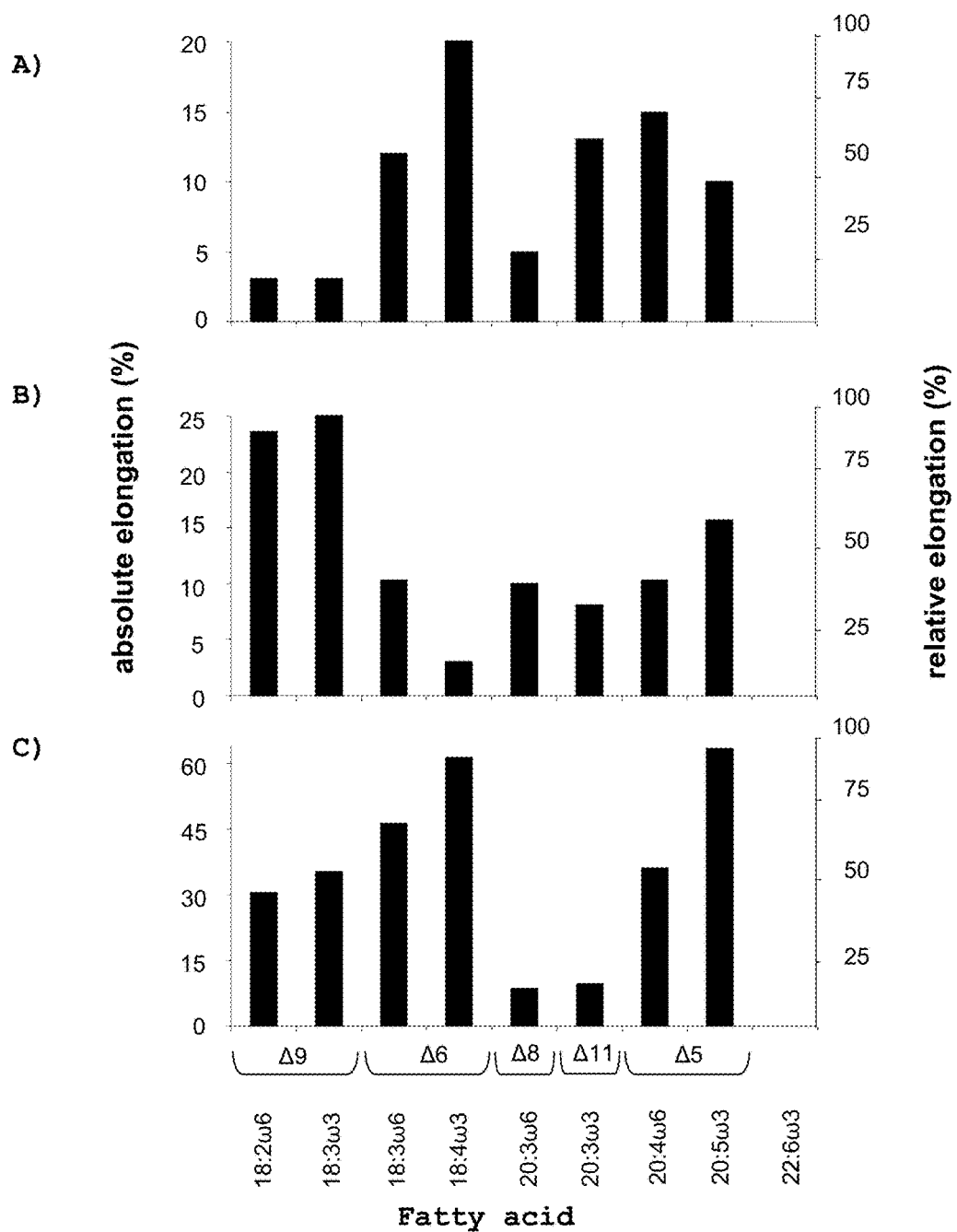
Figure 27: Substrate specificity of the Xenopus Elongase (A), Ciona Elongase (B) und Oncorhynchus Elongase (C)

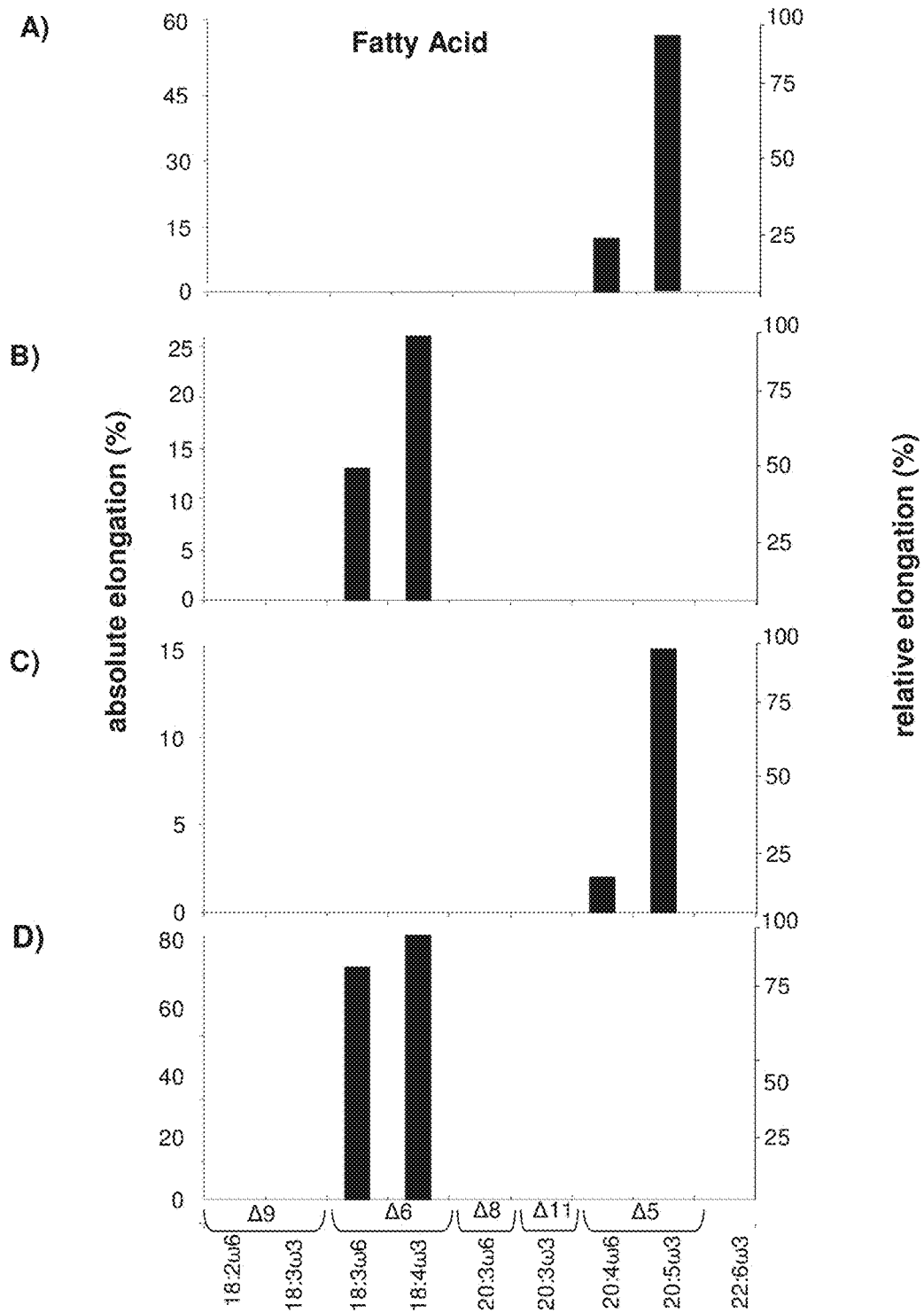
Figure 28: Substrate specificity of the Ostreococcus Δ5-elongase (A), the Ostreococcus Δ6-elongase (B), the Thalassiosira Δ5-elongase (C) and the Thalassiosira Ostreococcus Δ6-elongase (D)

Figure 29: Expression of the Phaeodactylum tricornutum Δ6-elongase (PtELO6) in yeast. A) shows the elongation of the $C18:3^{\Delta6,9,12}$ fatty acid and B) the elongation of the $C18:3^{\Delta6,9,12,15}$ fatty acid
A)
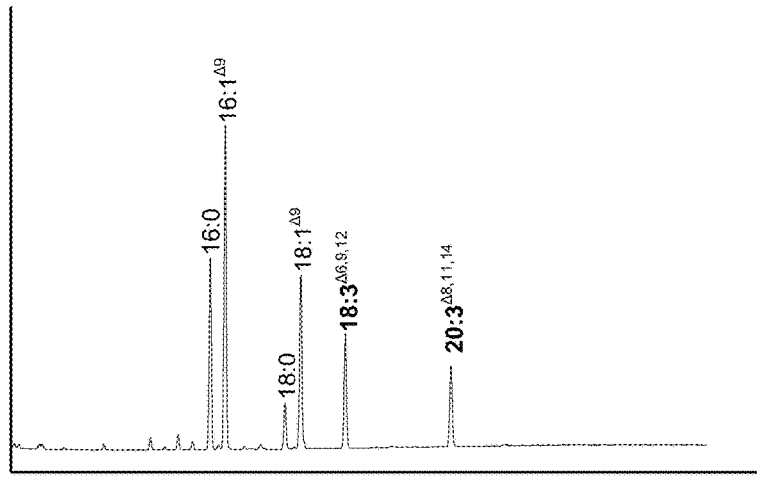
B)
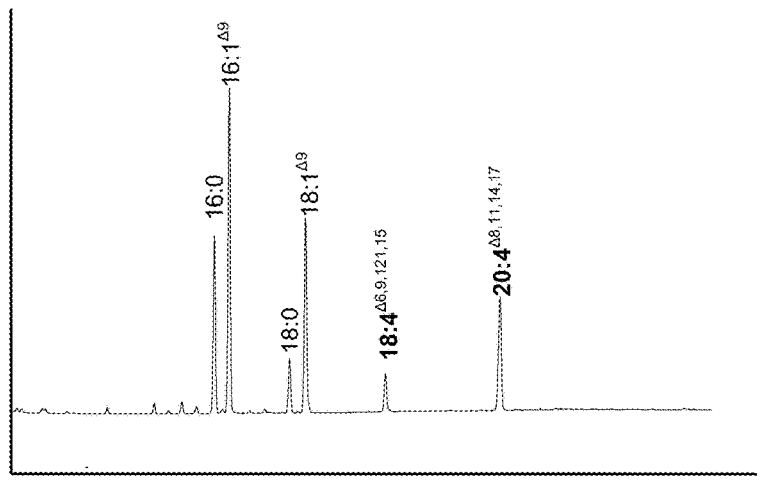

Figure 30: Figure 30 shows the substrate specificity of PtELO6 with regard to the substrates fed.
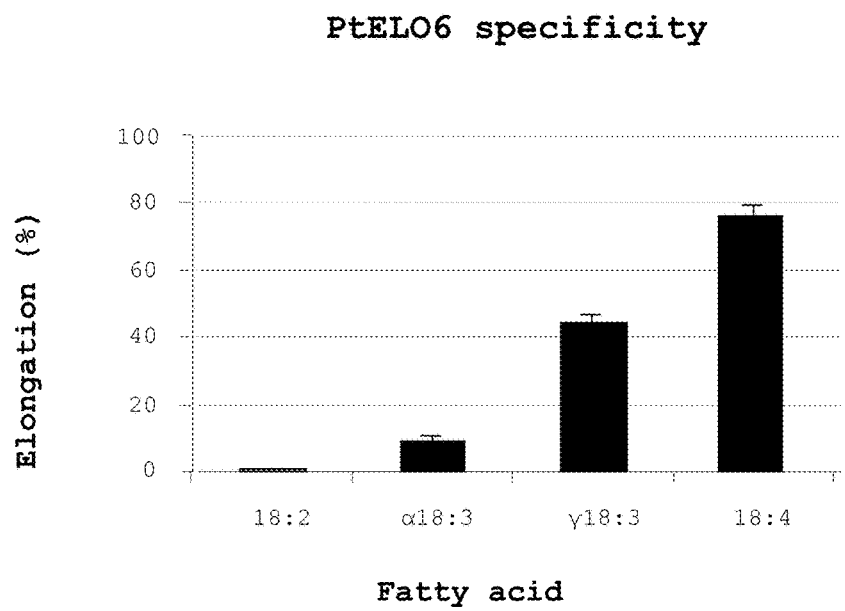

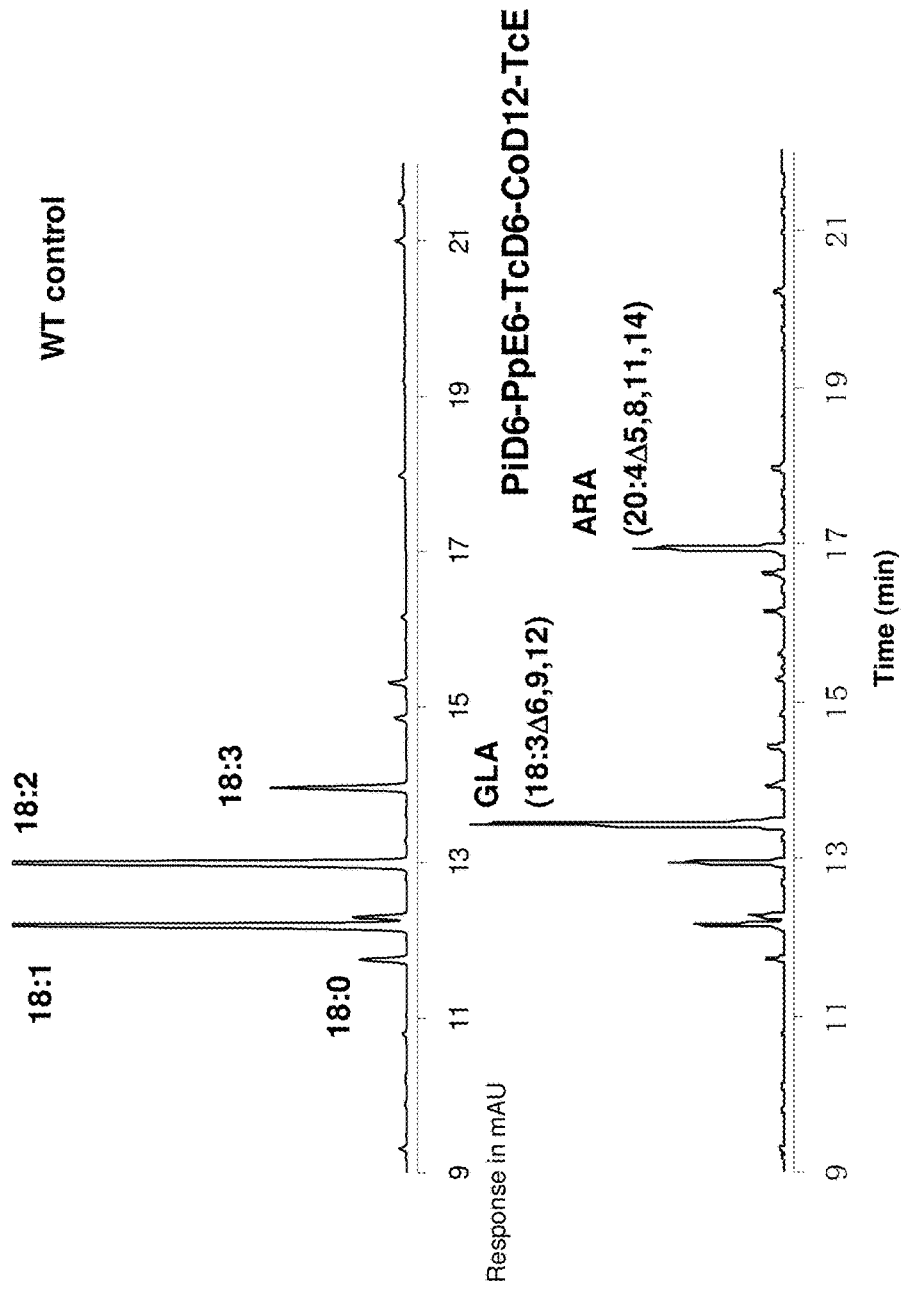
Figure 31: Gas-chromatographic analysis of the seed of a transgenic plant, transformed with pSUN-5G.

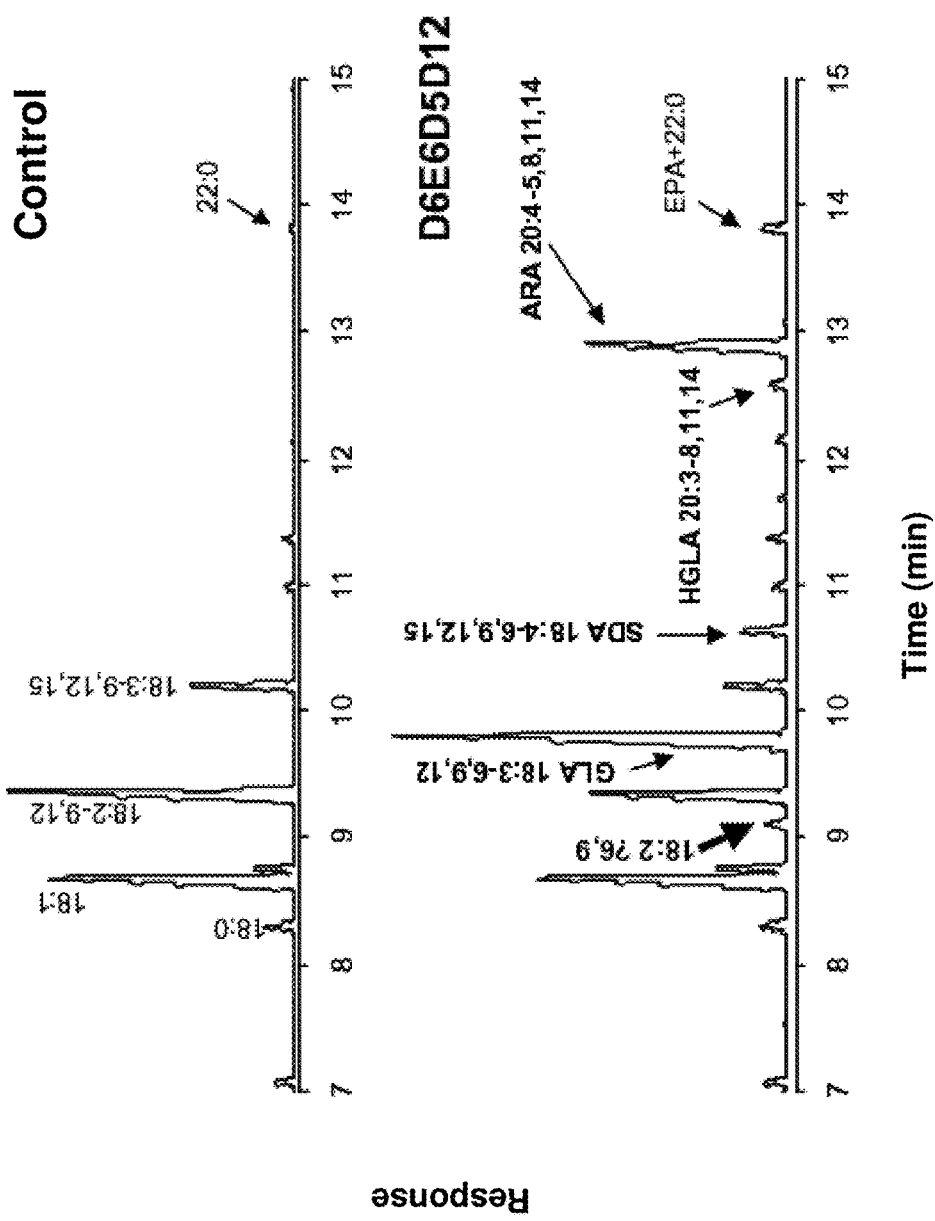
Figure 32: Gas-chromatographic analysis of the seed of a transgenic plant, transformed with pGPTV-D6Des(Pir)_D5Des(Tc)_D6Elo(PP)_12Des(Co)

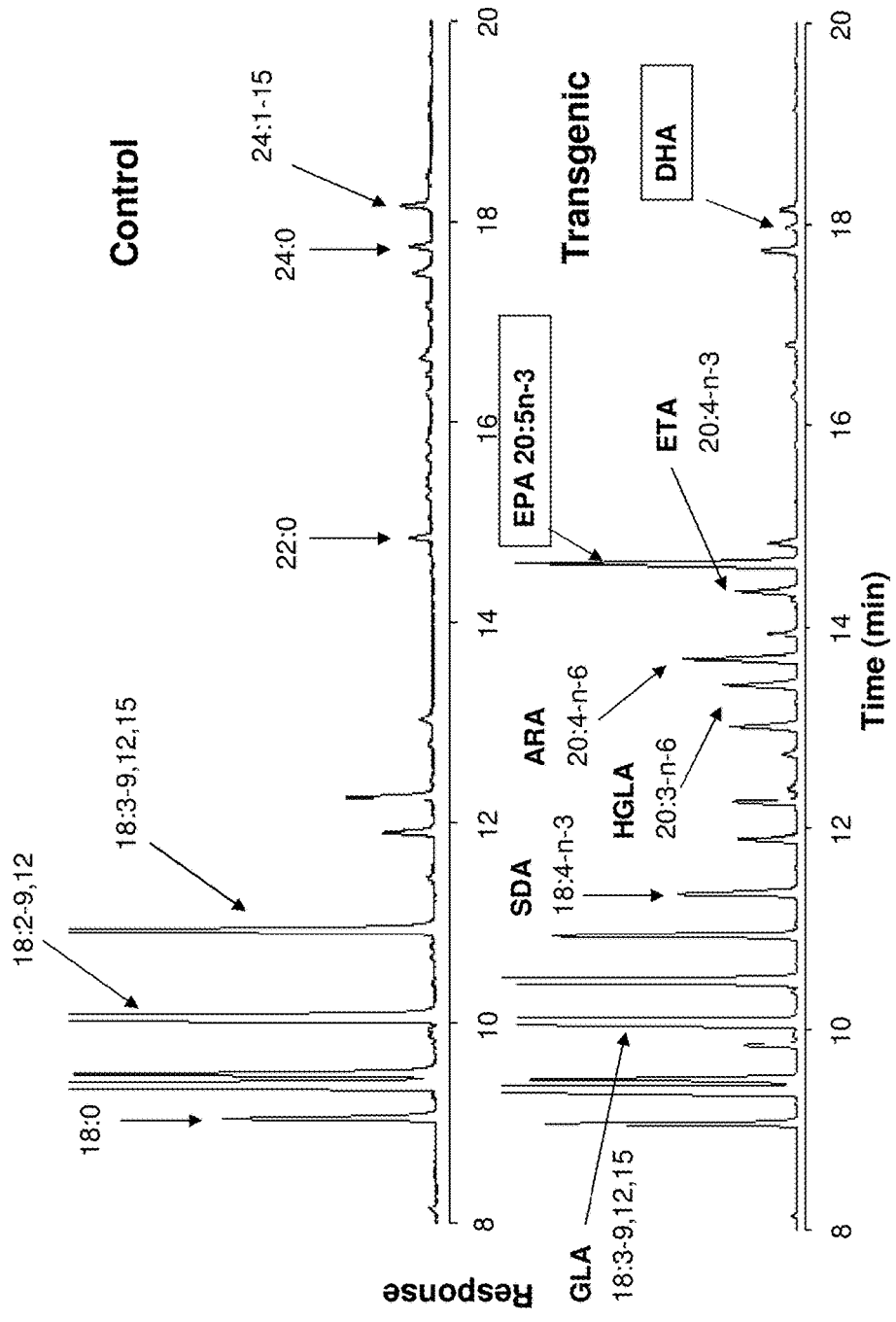
Figure 33: DHA in transgenic seeds of Brassica juncea. The plants were transformed with the construct pSUN-8G.

METHOD FOR PRODUCING POLYUNSATURATED FATTY ACIDS IN TRANSGENIC PLANTS

RELATED APPLICATIONS

This application is a continuation of patent application Ser. No. 10/590,457 filed Aug. 25, 2006, which is a national stage application (under 35 U.S.C. § 371) of PCT/EP2005/001863 filed Feb. 23, 2005, which claims benefit of German application 10 2004 009 457.8 filed Feb. 27, 2004; German application 10 2004 012 370.5 filed Mar. 13, 2004; German application 10 2004 017 518.7 filed Apr. 8, 2004; German application 10 2004 024 014.0 filed May 14, 2004; PCT application PCT/EP2004/07957 filed Jun. 16, 2004; and German application 10 2004 062 543.3 filed Dec. 24, 2004. The entire content of each aforementioned application is hereby incorporated by reference in its entirety.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Sequence_Listing_074021_0020_01. The size of the text file is 622 KB, and the text file was created on Sep. 2, 2015.

FIELD OF THE INVENTION

The present invention relates to a process for the production of polyunsaturated fatty acids in the seed of transgenic plants by introducing, into the organism, nucleic acids which encode polypeptides with ω3-desaturase, Δ12-desaturase, Δ6-desaturase, Δ6-elongase, Δ5-desaturase, Δ5-elongase and/or Δ4-desaturase activity, preferably polypeptides with Δ6-desaturase, Δ6-elongase and Δ5-desaturase activity.

The nucleic acid sequences are the sequences shown in SEQ ID NO: 11, SEQ ID NO: 27, SEQ ID NO: 193, SEQ ID NO: 197, SEQ ID NO: 199 and SEQ ID NO: 201. Preferably, a further nucleic acid sequence which encodes a polypeptide with a Δ12-desaturase activity is additionally introduced into the plant, in addition to these nucleic acid sequences, and also expressed simultaneously. Especially preferably, this is the nucleic acid sequence shown in SEQ ID NO: 195.

These nucleic acid sequences can advantageously be expressed in the organism, if appropriate together with further nucleic acid sequences which encode polypeptides of the biosynthesis of the fatty acid or lipid metabolism. Especially advantageous are nucleic acid sequences which encode a Δ6-desaturase, a Δ5-desaturase, Δ4-desaturase, Δ12-desaturase and/or Δ6-elongase activity. These desaturases and elongases originate advantageously from *Thalassiosira*, *Euglena* or *Ostreococcus*. Furthermore, the invention relates to a process for the production of oils and/or triacylglycerides with an elevated content of long-chain polyunsaturated fatty acids.

In a preferred embodiment, the invention furthermore relates to a process for the production of arachidonic acid, eicosapentaenoic acid or docosahexaenoic acid and to a process for the production of triglycerides with an elevated content of unsaturated fatty acids, in particular arichidonic acid, eicosapentaenoic acid and/or docosahexaenoic acid, in transgenic plants, advantageously in the seed of the transgenic plant. The invention relates to the generation of a transgenic plant with an elevated content of polyunsaturated fatty acids, in particular arichidonic acid, eicosapentaenoic acid and/or docosahexaenoic acid, as the result of the expression of the elongases and desaturases used in the process according to the invention.

The invention furthermore relates to recombinant nucleic acid molecules comprising the nucleic acid sequences which encode the polypeptides with Δ6-desaturase, Δ6-elongase, Δ5-desaturase and Δ5-elongase activity, either jointly or individually, and transgenic plants which comprise the abovementioned recombinant nucleic acid molecules.

A further part of the invention relates to oils, lipids and/or fatty acids which have been produced by the process according to the invention, and to their use. Moreover, the invention relates to unsaturated fatty acids and to triglycerides with an elevated content of unsaturated fatty acids and to their use.

DESCRIPTION OF RELATED ART

Lipid synthesis can be divided into two sections: the synthesis of fatty acids and their binding to sn-glycerol-3-phosphate, and the addition or modification of a polar head group. Usual lipids which are used in membranes comprise phospholipids, glycolipids, sphingolipids and phosphoglycerides. Fatty acid synthesis starts with the conversion of acetyl-CoA into malonyl-CoA by acetyl-CoA carboxylase or into acetyl-ACP by acetyl transacylase. After condensation reaction, these two product molecules together form acetoacetyl-ACP, which is converted via a series of condensation, reduction and dehydration reactions so that a saturated fatty acid molecule with the desired chain length is obtained. The production of the unsaturated fatty acids from these molecules is catalyzed by specific desaturases, either aerobically by means of molecular oxygen or anaerobically (regarding the fatty acid synthesis in microorganisms, see F. C. Neidhardt et al. (1996) *E. coli* and *Salmonella*. ASM Press: Washington, D.C., p. 612-636 and references cited therein; Lengeler et al. (Ed.) (1999) Biology of Procaryotes. Thieme: Stuttgart, N.Y., and the references therein, and Magnuson, K., et al. (1993) Microbiological Reviews 57:522-542 and the references therein). To undergo the further elongation steps, the resulting phospholipid-bound fatty acids must be returned to the fatty acid CoA ester pool. This is made possibly by acyl-CoA:lysophospholipid acyltransferases. Moreover, these enzymes are capable of transferring the elongated fatty acids from the CoA esters back to the phospholipids. If appropriate, this reaction sequence can be followed repeatedly.

Furthermore, fatty acids must subsequently be transported to various modification sites and incorporated into the triacylglycerol storage lipid. A further important step during lipid synthesis is the transfer of fatty acids to the polar head groups, for example by glycerol fatty acid acyltransferase (see Frentzen, 1998, Lipid, 100(4-5):161-166).

With regard to publications on the biosynthesis of fatty acids in plants, desaturation, the lipid metabolism and the membrane transport of lipidic compounds, beta-oxidation, the modification of fatty acids and cofactors and the storage and assembly of triacylglycerol, including the references cited therein, see the following papers: Kinney, 1997, Genetic Engineering, Ed.: J K Setlow, 19:149-166; Ohlrogge and Browse, 1995, Plant Cell 7:957-970; Shanklin and Cahoon, 1998, Annu. Rev. Plant Physiol. Plant Mol. Biol. 49:611-641; Voelker, 1996, Genetic Engineering, Ed.: J K Setlow, 18:111-13; Gerhardt, 1992, Prog. Lipid R. 31:397-417; Gühnemann-Schafer & Kindl, 1995, Biochim. Biophys Acta 1256:181-186; Kunau et al., 1995, Prog. Lipid Res.

34:267-342; Stymne et al., 1993, in: Biochemistry and Molecular Biology of Membrane and Storage Lipids of Plants, Eds.: Murata and Somerville, Rockville, American Society of Plant Physiologists, 150-158, Murphy & Ross 1998, Plant Journal. 13(1):1-16.

In the text which follows, polyunsaturated fatty acids are referred to as PUFA, PUFAs, LCPUFA or LCPUFAs (poly unsaturated fatty acids, PUFA long chain poly unsaturated fatty acids LCPUFA).

Fatty acids and triacylglycerides have a multiplicity of applications in the food industry, in animal nutrition, in cosmetics and the pharmacological sector. Depending on whether they are free saturated or unsaturated fatty acids or else triacylglycerides with an elevated content of saturated or unsaturated fatty acids, they are suitable for very different applications. Polyunsaturated fatty acids such as linoleic and linolenic acid are essential for mammals since they cannot be produced by the latter. This is why polyunsaturated ω3-fatty acids and ω6-fatty acids are an important constituent of human and animal food. Thus, for example, lipids with unsaturated fatty acids, specifically with polyunsaturated fatty acids, are preferred in human nutrition. The polyunsaturated ω3-fatty acids are supposed to have a positive effect on the cholesterol level in the blood and thus on the prevention of heart disease. The risk of heart disease, strokes or hypertension can be reduced markedly by adding these ω3-fatty acids to the food (Shimikawa 2001, World Rev. Nutr. Diet. 88, 100-108).

ω3-fatty acids also have a positive effect on inflammatory, specifically on chronically inflammatory, processes in association with immunological diseases such as rheumatoid arthritis (Calder 2002, Proc. Nutr. Soc. 61, 345-358; Cleland and James 2000, J. Rheumatol. 27, 2305-2307). They are therefore added to foodstuffs, specifically to dietetic foodstuffs, or are employed in medicaments. ω6-fatty acids such as arachidonic acid tend to have a negative effect in connection with these rheumatological diseases.

ω3- and ω6-fatty acids are precursors of tissue hormones, known as eicosanoids, such as the prostaglandins, which are derived from dihomo-γ-linolenic acid, arachidonic acid and eicosapentaenoic acid, and of the thromboxanes and leukotrienes, which are derived from arachidonic acid and eicosapentaenoic acid. Eicosanoids (known as the $PG_2$ series) which are formed from the ω6-fatty acids, generally promote inflammatory reactions, while eicosanoids (known as the $PG_3$ series) from ω3-fatty acids have little or no proinflammatory effect.

Polyunsaturated long-chain ω3-fatty acids such as eicosapentaenoic acid (=EPA, $C20:5^{\Delta 5,8,11,14,17}$) or docosahexaenoic acid (=DHA, $C22:6^{\Delta 4,7,10,13,16,19}$) are important components of human nutrition owing to their various roles in health aspects, including the development of the child brain, the functionality of the eyes, the synthesis of hormones and other signal substances, and the prevention of cardiovascular disorders, cancer and diabetes (Poulos, A Lipids 30:1-14, 1995; Horrocks, L A and Yeo Y K Pharmacol Res 40:211-225, 1999). There is therefore a demand for the production of polyunsaturated long-chain fatty acids.

Owing to the present-day composition of human food, an addition of polyunsaturated ω3-fatty acids, which are preferentially found in fish oils, to the food is particularly important. Thus, for example, polyunsaturated fatty acids such as docosahexaenoic acid (=DHA, $C22:6^{\Delta 4,7,10,13,16,19}$) or eicosapentaenoic acid (=EPA, $C20:5^{\Delta 5,8,11,14,17}$) are added to infant formula to improve the nutritional value. The unsaturated fatty acid DHA is supposed to have a positive effect on the development and maintenance of brain function. There is therefore a demand for the production of polyunsaturated long-chain fatty acids.

The various fatty acids and triglycerides are mainly obtained from microorganisms such as *Mortierella* or *Schizochytrium* or from oil-producing plants such as soybeans, oilseed rape, algae such as *Crypthecodinium* or *Phaeodactylum* and others, being obtained, as a rule, in the form of their triacylglycerides (=triglycerides=triglycerols). However, they can also be obtained from animals, for example, fish. The free fatty acids are advantageously prepared by hydrolysis. Very long-chain polyunsaturated fatty acids such as DHA, EPA, arachidonic acid (ARA, $C20:4^{\Delta 5,8,11,14}$), dihomo-γ-linolenic acid ($C20:3^{\Delta 8,11,14}$) or docosapentaenoic acid (DPA, $C22:5^{\Delta 7,10,13,16,19}$) are, however, not synthesized in oil crops such as oilseed rape, soybeans, sunflowers and safflower. Conventional natural sources of these fatty acids are fish such as herring, salmon, sardine, redfish, eel, carp, trout, halibut, mackerel, zander or tuna, or algae.

Depending on the intended use, oils with saturated or unsaturated fatty acids are preferred. In human nutrition, for example, lipids with unsaturated fatty acids, specifically polyunsaturated fatty acids, are preferred. The polyunsaturated ω3-fatty acids are said to have a positive effect on the cholesterol level in the blood and thus on the possibility of preventing heart disease. The risk of heart disease, stroke or hypertension can be reduced markedly by adding these ω3-fatty acids to the food. Also, ω3-fatty acids have a positive effect on inflammatory, specifically on chronically inflammatory, processes in association with immunological diseases such as rheumatoid arthritis. They are therefore added to foodstuffs, specifically to dietetic foodstuffs, or are employed in medicaments. ω3-fatty acids such as arachidonic acid tend to have an adverse effect on these disorders in connection with these rheumatic diseases on account of our usual dietary intake.

Owing to their positive characteristics, there has been no lack of attempts in the past to make available genes which are involved in the synthesis of these fatty acids or triglycerides for the production of oils in various organisms with a modified content of unsaturated fatty acids. Thus, WO 91/13972 and its US equivalent describe a Δ9-desaturase. WO 93/11245 claims a Δ15-desaturase and WO 94/11516 a Δ12-desaturase. Further desaturates are described, for example, in EP-A-0 550 162, WO 94/18337, WO 97/30582, WO 97/21340, WO 95/18222, EP-A-0 794 250, Stukey et al., J. Biol. Chem., 265, 1990: 20144-20149, Wada et al., Nature 347, 1990: 200-203 or Huang et al., Lipids 34, 1999: 649-659. However, the biochemical characterization of the various desaturases has been insufficient to date since the enzymes, being membrane-bound proteins, present great difficulty in their isolation and characterization (McKeon et al., Methods in Enzymol. 71, 1981: 12141-12147, Wang et al., Plant Physiol. Biochem., 26, 1988: 777-792). As a rule, membrane-bound desaturases are characterized by being introduced into a suitable organism which is subsequently analyzed for enzyme activity by analyzing the starting materials and the products. Δ6-Desaturases are described in WO 93/06712, U.S. Pat. No. 5,614,393, U.S. Pat. No. 5,614,393 WO 96/21022, WO 00/21557 and WO 99/27111. The application of this enzyme for the production of fatty acids in transgenic organisms is described in WO 98/46763, WO 98/46764 and WO 98/46765. The expression of various desaturases is described and claimed in WO 99/64616 or WO 98/46776. As regards the expression efficacy of desaturases and its effect on the formation of polyunsaturated fatty acids, it must be noted that the expression of a single desaturase as described to date has only resulted in low contents of unsaturated fatty acids/lipids such as, for example, γ-linolenic acid and stearidonic acid.

There have been a number of attempts in the past to obtain elongase genes. Millar and Kunst, 1997 (Plant Journal 12:121-131) and Millar et al., 1999 (Plant Cell 11:825-838) describe the characterization of plant elongases for the synthesis of monounsaturated long-chain fatty acids (C22:1) and for the synthesis of very long-chain fatty acids for the formation of waxes in plants ($C_{28}$-$C_{32}$). The synthesis of arachidonic acid and EPA is described, for example, in WO 01/59128, WO 00/12720, WO 02/077213 and WO 02/08401. The synthesis of polyunsaturated C24-fatty acids is described, for example, in Tvrdik et al. 2000, J. Cell Biol. 149:707-718 or WO 02/44320.

Especially suitable microorganisms for the production of PUFAs are microorganisms such as microalgae such as *Phaeodactylum tricornutum, Porphiridium* species, *Thraustochytrium* species, *Schizochytrium* species or *Cryptheco-dinium* species, ciliates such as *Stylonychia* or *Colpidium*, fungi such as *Mortierella, Entomophthora* or Mucor and/or mosses such as *Physcomitrella, Ceratodon* and *Marchantia* (R. Vazhappilly & F. Chen (1998) Botanica Marina 41: 553-558; K. Totani & K. Oba (1987) Lipids 22: 1060-1062; M. Akimoto et al. (1998) Appl. Biochemistry and Biotechnology 73: 269-278). Strain selection has resulted in the development of a number of mutant strains of the microorganisms in question which produce a series of desirable compounds including PUFAs. However, the mutation and selection of strains with an improved production of a particular molecule such as the polyunsaturated fatty acids is a time-consuming and difficult process, which is why as described above recombinant methods are preferred. However, only limited amounts of the desired polyunsaturated fatty acids such as DPA, EPA or ARA can be produced with the aid of the abovementioned microorganisms; where, as a rule, they are generally obtained as fatty acid mixtures, depending on the microorganisms used.

Higher plants comprise polyunsaturated fatty acids such as linoleic acid (C18:2) and linolenic acid (C18:3). ARA, EPA and DHA are found not at all in the seed oil of higher plants, or only in miniscule amounts (E. Ucciani: Nouveau Dictionnaire des Huiles Végétales [New Dictionary of the Vegetable Oils]. Technique & Documentation—Lavoisier, 1995. ISBN: 2-7430-0009-0). However, the production of LCPUFAs in higher plants, preferably in oilseed crops such as oilseed rape, linseed, sunflowers and soybeans, would be advantageous since large amounts of high-quality LCPUFAs for the food industry, animal nutrition and pharmaceutical purposes might be obtained economically. To this end, it is advantageous to introduce, into oilseed crops, genes which encode enzymes of the LCPUFA biosynthesis via recombinant methods and to express them therein. These genes encode for example Δ6-desaturases, Δ6-elongases, Δ5-desaturases, Δ5-elongases or Δ4-desaturases. These genes can advantageously be isolated from microorganisms and lower plants which produce LCPUFAs and incorporate them in the membranes or triacylglycerides. Thus, it has already been possible to isolate Δ6-desaturase genes from the moss *Physcomitrella patens* and Δ6-elongase genes from *P. patens* and from the nematode *C. elegans*.

A variety of synthetic pathways is being discussed for the synthesis of arachidonic acid, eicosapentaenoic acid (EPA) and docosahexaenoic acid (DHA) (FIG. 1). Thus, EPA or DHA are produced in marine bacteria such as *Vibrio* sp. or *Shewanella* sp. via the polyketide pathway (Yu, R. et al. Lipids 35:1061-1064, 2000; Takeyama, H. et al. Microbiology 143:2725-2731, 1997).

An alternative strategy is the alternating activity of desaturases and elongases (Zank, T. K. et al. Plant Journal 31:255-268, 2002; Sakuradani, E. et al. Gene 238:445-453, 1999). A modification of the above-described pathway by Δ6-desaturase, Δ6-elongase, Δ5-desaturase, Δ5-elongase and Δ4-desaturase is the Sprecher pathway (Sprecher 2000, Biochim. Biophys. Acta 1486:219-231) in mammals. Instead of the Δ4-desaturation, a further elongation step is effected here to give $C_{24}$, followed by a further Δ6-desaturation and finally β-oxidation to give the $C_{22}$ chain length. Thus what is known as Sprecher pathway (see FIG. 1) is, however, not suitable for the production in plants and microorganisms since the regulatory mechanisms are not known.

Depending on their desaturation pattern, the polyunsaturated fatty acids can be divided into two large classes, viz. ω6- or ω3-fatty acids, which differ with regard to their metabolic and functional activities (FIG. 1).

The starting material for the ω6-metabolic pathway is the fatty acid linoleic acid ($18:2^{\Delta 9,12}$) while the ω3-pathway proceeds via linolenic acid ($18:3^{\Delta 9,12,15}$). Linolenic acid is formed by the activity of an ω3-desaturase (Tocher et al. 1998, Prog. Lipid Res. 37, 73-117; Domergue et al. 2002, Eur. J. Biochem. 269, 4105-4113).

Mammals, and thus also humans, have no corresponding desaturase activity (Δ12- and ω3-desaturase) and must take up these fatty acids (essential fatty acids) via the food. Starting with these precursors, the physiologically important polyunsaturated fatty acids arachidonic acid (=ARA, $20:4^{\Delta 5,8,11,14}$), an ω6-fatty acid and the two ω3-fatty acids eicosapentaenoic acid (=EPA, $20:5^{\Delta 5,8,11,14,17}$) and docosahexaenoic acid (DHA, $22:6^{\Delta 4,7,10,13,17,19}$) are synthesized via the sequence of desaturase and elongase reactions. The application of ω3-fatty acids shows the therapeutic activity described above in the treatment of cardiovascular diseases (Shimikawa 2001, World Rev. Nutr. Diet. 88, 100-108), inflammations (Calder 2002, Proc. Nutr. Soc. 61, 345-358) and arthritis (Cleland and James 2000, J. Rheumatol. 27, 2305-2307).

From the angle of nutritional physiology, it is therefore advantageous to achieve a shift between the ω6-synthetic pathway and the ω3-synthetic pathway (see FIG. 1) so that more ω3-fatty acids are produced. The enzymatic activities of various ω3-desaturases which desaturate $C_{18:2}$-, $C_{22:4}$- or $C_{22:5}$-fatty acids have been described in the literature (see FIG. 1). However, none of the desaturases whose biochemistry has been described converts a broad range of substrates of the ω6-synthetic pathway into the corresponding fatty acids of the ω3-synthetic pathway.

The elongation of fatty acids, by elongases, by 2 or 4 C atoms is of crucial importance for the production of $C_{20}$- and $C_{22}$-PUFAs, respectively. This process proceeds via 4 steps. The first step is the condensation of malonyl-CoA onto the fatty-acid-acyl-CoA by ketoacyl-CoA synthase (KCS, hereinbelow referred to as elongase). This is followed by a reduction step (ketoacyl-CoA reductase, KCR), a dehydratation step (dehydratase) and a final reduction step (enoyl-CoA reductase). It has been postulated that the elongase activity affects the specificity and rate of the entire process (Millar and Kunst, 1997 Plant Journal 12:121-131).

No specific elongase has been described to date for the production of DHA (C22:6 n-3) in organisms which do not naturally produce this fatty acid. Only elongases which provide C$_{20}$- or C$_{24}$-fatty acids have been described to date. A Δ5-elongase activity has not been described to date.

The first transgenic plants which comprise and express genes encoding LCPUFA biosynthesis enzymes and which, as a consequence, produce LCPUFAs were described for the first time, for example, in DE-A-102 19 203 (Process for the production of polyunsaturated fatty acids in plants) or in WO 2004/071467. However, these plants produce LCPUFAs in amounts which require further optimization for processing the oils which are present in the plants. Thus, ARA content in the plants described in DE-A-102 19 203 only amounts to 0.4 to 2% and the EPA content only to 0.5 to 1%, in each case based on the total lipid content of the plants. WO 2004/071467 discloses higher contents of polyunsaturated C$_{20}$- and C$_{22}$-fatty acids such as ARA, EPA or DHA. However, the process disclosed has a series of grave disadvantages. It seems that DHA cannot be detected at all in the seeds in the process disclosed. To produce PUFAs, soybean is less suitable, owing to its low oil content of approximately only 20% by weight. Soybean is an advantageous protein source and is therefore grown on a large scale. However, the oil content of soybeans is rather low. Moreover, the dihomo-γ-linolenic acid (=DGHL or HGLA) content obtained in the production process is much too high. HGLA is hardly detectable in fish oils or algal oils or microbial oils. A further disadvantage is that the plants disclosed in WO 2004/071467 were generated by cotransformation, which leads to the segregation of the characteristics in the subsequent generations, and thus to an increased selection effort.

To make possible the fortification of food and/or of feed with these polyunsaturated fatty acids, there is therefore a great need for a simple, inexpensive process for the production of these polyunsaturated fatty acids in plant systems, especially in the seed of transgenic plants.

BRIEF DESCRIPTION OF THE DRAWINGS

FIG. 1 shows various synthetic pathways for the biosynthesis of DHA (docosahexaenoic acid).

FIG. 2 shows substrate specificity of the Δ5-elongase (SEQ ID NO: 53) with regard to different fatty acids.

FIG. 3 shows reconstitution of DHA biosynthesis in yeast starting from 20:5ω3.

FIG. 4 shows reconstitution of DHA biosynthesis in yeast starting from 18:4ω3.

FIG. 5 shows fatty acid composition (in mol %) of transgenic yeasts which had been transformed with the vectors pYes3-OmELO3/pYes2-EgD4 or pYes3-OmELO3/pYes2-EgD4+pESCLeu-PtD5. The yeast cells were cultured in minimal medium without tryptophan and uracil/and leucin in the presence of 250M 20:5$^{Δ5,8,11,14,17}$ and 18:4$^{Δ6,9,12,15}$, respectively. The fatty acid methyl esters were obtained from cell sediments by acid methanolysis and analyzed via GLC. Each value represents the mean (n=4)±standard deviation.

FIG. 6 shows feeding experiment for determining the functionality and substrate specificity with yeast strains.

FIG. 7 shows elongation of eicosapentaenoic acid by OtElo1.

FIG. 8 shows elongation of arachidonic acid by OtElo1.

FIG. 9 shows expression of TpELO1 in yeast.

FIG. 10 shows expression of TpELO3 in yeast.

FIG. 11 shows expression of *Thraustochytrium* Δ5-elongase TL16/pYES2.1 in yeast.

FIG. 12 shows desaturation of γ-linolenic acid (18:2 ω6-fatty acid) to give α-linolenic acid (18:3 ω3-fatty acid) by Pi-omega3Des.

FIG. 13 shows desaturation of γ-linolenic acid (18:2 ω6-fatty acid) to give stearidonic acid (18:4 ω3-fatty acid) by Pi-omega3Des.

FIG. 14 shows desaturation of C20:2 ω6-fatty acid to give C20:3 ω3-fatty acid by Pi-omega3Des.

FIG. 15 shows desaturation of C20:3 ω6-fatty acid to give C20:4 ω3-fatty acid by Pi-omega3Des.

FIG. 16 shows desaturation of arachidonic acid (C20:4 ω6-fatty acid) to give eicosapentaenoic acid (C20:5 ω3-fatty acid) by Pi-omega3Des.

FIG. 17 shows desaturation of docosatetraenoic acid (C22:4 ω6-fatty acid) to give docosapentaenoic acid (C22:5 ω3-fatty acid) by Pi-omega3Des.

FIG. 18 shows substrate specificity of Pi-omega3Des with regard to different fatty acids.

FIG. 19 shows desaturation of phospholipid-bound arachidonic acid to give EPA by Pi-Omega3Des.

FIG. 20 shows conversion of linoleic acid (arrow) to give γ-linolenic acid (γ-18:3) by OtDes6.1.

FIG. 21 shows conversion of linoleic acid and α-linolenic acid (A and C), and reconstitution of the ARA and EPA synthetic pathways, respectively, in yeast (B and D) in the presence of OtD6.1.

FIG. 22 shows expression of ELO(XI) in yeast.

FIG. 24 shows elongation of eicosapentaenoic acid by OtElo1 (B) and OtElo1.2 (D), respectively. The controls (A, C) do not show the elongation product (22:5ω3).

FIG. 25 shows elongation of arachidonic acid by OtElo1 (B) and OtElo1.2 (D), respectively. The controls (A, C) do not show the elongation product (22:4ω6).

FIG. 26 shows elongation of 20:5n-3 by the elongases At3g06470.

FIG. 27 shows substrate specificity of the *Xenopus* Elongase (A), *Ciona* Elongase (B) and *Oncorhynchus* Elongase (C).

FIG. 28 shows substrate specificity of the *Ostreococcus* Δ5-elongase (A), the *Ostreococcus* Δ6-elongase (B), the *Thalassiosira* Δ5-elongase (C) and the *Thalassiosira* Δ6-elongase (D).

FIG. 29 shows expression of the *Phaeodactylum tricornutum* Δ6-elongase (PtELO6) in yeast. A) shows the elongation of the C18:3$^{Δ6,9,12}$ fatty acid and B) the elongation of the C18:3$^{Δ6,9,12,15}$ fatty acid.

FIG. 30 shows the substrate specificity of PtELO6 with regard to the substrates fed.

FIG. 31 shows gas-chromatographic analysis of the seed of a transgenic plant, transformed with pSUN-5G.

FIG. 32 shows gas-chromatographic analysis of the seed of a transgenic plant, transformed with pGPTV-D6Des(Pir)_D5Des(Tc)_D6Elo(PP)_12 Des(Co).

FIG. 33 shows DHA in transgenic seeds of *Brassica juncea*. The plants were transformed with the construct pSUN-8G.

DETAILED DESCRIPTION OF THE INVENTION

Figure 23:
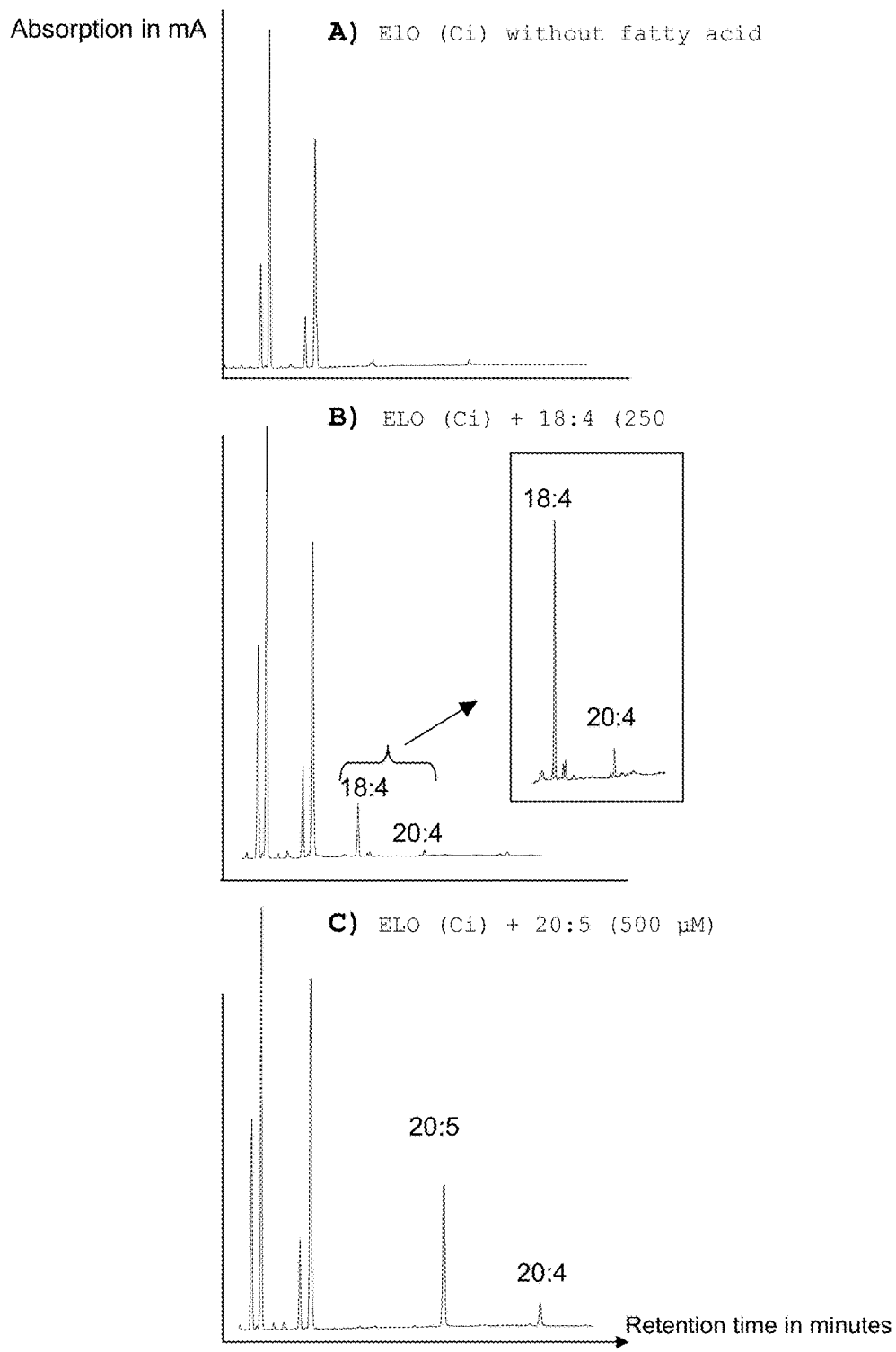
FIG. 23 shows substrate specificity of ELO(Ci).

The object of the invention was therefore to develop a process for the production of large amounts of polyunsaturated fatty acids, specifically ARA, EPA and DHA, in the seed of a transgenic plant. This object was achieved by the process according to the invention for the production of compounds of the general formula I

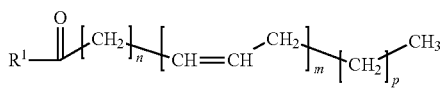  (I)

in the seeds of transgenic plants with a content of at least 20% by weight based on the total lipid content, which comprises the following process steps:
a) introducing, into the organism, at least one nucleic acid sequence which encodes a Δ9-elongase and Δ6-desaturase activity, and
b) introducing, into the organism, at least one nucleic acid sequence which encodes a Δ8-desaturase and Δ6-elongase activity, and
c) introducing, into the organism, at least one nucleic acid sequence which encodes a Δ5-desaturase activity, and
d) introducing, into the organism, at least one nucleic acid sequence which encodes a Δ5-elongase activity, and
e) introducing, into the organism, at least one nucleic acid sequence which encodes a Δ4-desaturase activity, and
where the variables and substituents in formula I have the following meanings:
$R^1$=hydroxyl, coenzyme A (thioester), lysophosphatidylcholine, lysophosphatidylethanolamine, lysophosphatidylglycerol, lysodiphosphatidylglycerol, lysophosphatidylserine, lysophosphatidylinositol, sphingo base or a radical of the formula II

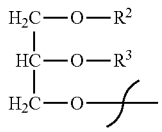  (II)

$R^2$=hydrogen, lysophosphatidylcholine, lysophosphatidylethanolamine, lysophosphatidylglycerol, lysodiphosphatidylglycerol, lysophosphatidylserine, lysophosphatidylinositol or saturated or unsaturated $C_2$-$C_{24}$-alkylcarbonyl,
$R^3$=hydrogen, saturated or unsaturated $C_2$-$C_{24}$-alkylcarbonyl, or $R^2$ and $R^3$ independently of one another are a radical of the formula Ia:

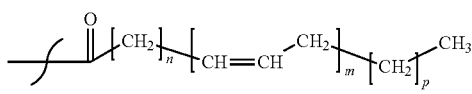  (Ia)

n=2, 3, 4, 5, 6, 7 or 9, m=2, 3, 4, 5 or 6 and p=0 or 3. Advantageously, the variables n, m and p in the abovementioned formula I and Ia denote the following: n=2, 3 or 5, m=4, 5 or 6 and p=0 or 3. In an especially advantageous embodiment of the process, the variables n, m and p in the formulae I and Ia denote the following: m=4, n=3, p=3 and the compounds of the general formula I and Ia thus denote arachidonic acid, and/or m=5, n=3, p=0 and the compounds of the general formula I and Ia thus denote eicosapentaenoic acid, and/or m=5, n=5, p=0 and the compounds of the general formula I and Ia thus denote docosapentaenoic acid is and/or m=6, n=3, p=0 and the compounds of the general formula I and Ia thus denote docosahexaenoic acid is.

$R^1$ in the general formula I is hydroxyl, coenzyme A (thioester), lysophosphatidylcholine, lysophosphatidylethanolamine, lysophosphatidylglycerol, lysodiphosphatidylglycerol, lysophosphatidylserine, lysophosphatidylinositol, sphingo base or a radical of the formula II

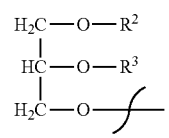  (II)

The abovementioned radicals of $R^1$ are always bonded to the compounds of the general formula I in the form of their thioesters.

$R^2$ in the general formula II is hydrogen, lysophosphatidylcholine, lysophosphatidylethanolamine, lysophosphatidylglycerol, lysodiphosphatidylglycerol, lysophosphatidylserine, lysophosphatidylinositol or saturated or unsaturated $C_2$-$C_{24}$-alkylcarbonyl.

Alkyl radicals which may be mentioned are substituted or unsubstituted, saturated or unsaturated $C_2$-$C_{24}$-alkylcarbonyl chains such as ethylcarbonyl, n-propylcarbonyl, n-butylcarbonyl, n-pentylcarbonyl, n-hexylcarbonyl, n-heptylcarbonyl, n-octylcarbonyl, n-nonylcarbonyl, n-decylcarbonyl, n-undecylcarbonyl, n-dodecylcarbonyl, n-tridecylcarbonyl, n-tetradecylcarbonyl, n-pentadecylcarbonyl, n-hexadecylcarbonyl, n-heptadecylcarbonyl, n-octadecylcarbonyl-, n-nonadecylcarbonyl, n-eicosylcarbonyl, n-docosanylcarbonyl- or n-tetracosanylcarbonyl, which comprise one or more double bonds. Saturated or unsaturated $C_{10}$-$C_{22}$-alkylcarbonyl radicals such as n-decylcarbonyl, n-undecylcarbonyl, n-dodecylcarbonyl, n-tridecylcarbonyl, n-tetradecylcarbonyl, n-pentadecylcarbonyl, n-hexadecylcarbonyl, n-heptadecylcarbonyl, n-octadecylcarbonyl, n-nonadecylcarbonyl, n-eicosylcarbonyl, n-docosanylcarbonyl or n-tetracosanylcarbonyl, which comprise one or more double bonds are preferred. Especially preferred are saturated and/or unsaturated $C_{10}$-$C_{22}$-alkylcarbonyl radicals such as $C_{10}$-alkylcarbonyl, $C_{11}$-alkylcarbonyl, $C_{12}$-alkylcarbonyl, $C_{13}$-alkylcarbonyl, $C_{14}$-alkylcarbonyl, $C_{16}$-alkylcarbonyl, $C_{18}$-alkylcarbonyl, $C_{20}$-alkylcarbonyl or $C_{22}$-alkylcarbonyl radicals which comprise one or more double bonds. Very especially preferred are saturated or unsaturated $C_{16}$-$C_{22}$-alkylcarbonyl radicals such as $C_{16}$-alkylcarbonyl, $C_{18}$-alkylcarbonyl, $C_{20}$-alkylcarbonyl or $C_{22}$-alkylcarbonyl radicals which comprise one or more double bonds. These advantageous radicals can comprise two, three, four, five or six double bonds. The especially preferred radicals with 20 or 22 carbon atoms in the fatty acid chain comprise up to six double bonds, advantageously three, four, five or six double bonds, especially preferably four, five or six double bonds, very especially preferably five or six. All the abovementioned radicals are derived from the corresponding fatty acids.

$R^3$ in the formula II is hydrogen, saturated or unsaturated $C_2$-$C_{24}$-alkylcarbonyl.

Alkyl radicals which may be mentioned are substituted or unsubstituted, saturated or unsaturated $C_2$-$C_{24}$-alkylcarbonyl chains such as ethylcarbonyl, n-propylcarbonyl, n-butylcarbonyl-, n-pentylcarbonyl, n-hexylcarbonyl, n-heptylcarbonyl, n-octylcarbonyl, n-nonylcarbonyl, n-decylcarbonyl, n-undecylcarbonyl, n-dodecylcarbonyl, n-tridecylcarbonyl, n-tetradecylcarbonyl, n-pentadecylcarbonyl, n-hexadecylcarbonyl, n-heptadecylcarbonyl, n-octadecylcarbonyl-, n-nonadecylcarbonyl, n-eicosylcarbonyl, n-docosanylcarbonyl- or n-tetracosanylcarbonyl, which comprise one or more double bonds. Saturated or unsaturated $C_{10}$-$C_{22}$-alkylcarbonyl radicals such as n-decylcarbonyl, n-undecylcarbonyl, n-dodecylcarbonyl, n-tridecylcarbonyl, n-tetradecylcarbonyl, n-pentadecylcarbonyl, n-hexadecylcarbonyl, n-heptadecylcarbonyl, n-octadecylcarbonyl, n-nonadecylcarbonyl, n-eicosylcarbonyl, n-docosanylcarbonyl or n-tetracosanylcarbonyl, which comprise one or more double bonds are preferred. Especially preferred are saturated and/or unsaturated $C_{10}$-$C_{22}$-alkylcarbonyl radicals such as $C_{10}$-alkylcarbonyl, $C_{11}$-alkylcarbonyl, $C_{12}$-alkylcarbonyl, $C_{13}$-alkylcarbonyl, $C_{14}$-alkylcarbonyl, $C_{16}$-alkylcarbonyl, $C_{18}$-alkylcarbonyl, $C_{20}$-alkylcarbonyl or $C_{22}$-alkylcarbonyl radicals which comprise one or more double bonds. Very especially preferred are saturated or unsaturated $C_{16}$-$C_{22}$-alkylcarbonyl radicals such as $C_{16}$-alkylcarbonyl, $C_{18}$-alkylcarbonyl, $C_{20}$-alkylcarbonyl or $C_{22}$-alkylcarbonyl radicals which comprise one or more double bonds. These advantageous radicals can comprise two, three, four, five or six double bonds. The especially preferred radicals with 20 or 22 carbon atoms in the fatty acid chain comprise up to six double bonds, advantageously three, four, five or six double bonds, especially preferably four, five or six double bonds, very especially preferably five or six. All the abovementioned radicals are derived from the corresponding fatty acids.

The abovementioned radicals of $R^1$, $R^2$ and $R^3$ can be substituted by hydroxyl and/or epoxy groups and/or can comprise triple bonds.

The polyunsaturated fatty acids produced in the process according to the invention advantageously comprise at least two, advantageously three, four, five or six, double bonds. The fatty acids especially advantageously comprise four, five or six double bonds. Fatty acids produced in the process advantageously have 18, 20 or 22 C atoms in the fatty acid chain; the fatty acids preferably comprise 20 or 22 carbon atoms in the fatty acid chain. Saturated fatty acids are advantageously reacted to a minor degree, or not at all, by the nucleic acids used in the process. To a minor degree is to be understood as meaning that the saturated fatty acids are reacted with less than 5% of the activity, advantageously less than 3%, especially advantageously with less than 2%, very especially preferably with less than 1, 0.5, 0.25 or 0.125% of the activity in comparison with polyunsaturated fatty acids. These fatty acids which have been produced can be produced in the process as a single product or be present in a fatty acid mixture.

The nucleic acid sequences used in the process according to the invention take the form of isolated nucleic acid sequences which encode polypeptides with Δ9-elongase, Δ6-desaturase, Δ8-desaturase, Δ6-elongase, Δ5-desaturase, Δ5-elongase and/or Δ4-desaturase activity.

Nucleic acid sequences which are advantageously used in the process according to the invention are nucleic acid sequences which encode polypeptides with Δ9-elongase, Δ6-desaturase, Δ8-desaturase, Δ6-elongase, Δ5-desaturase, Δ5-elongase or Δ4-desaturase activity selected from the group consisting of:

a) a nucleic acid sequence with the sequence shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 111, SEQ ID NO: 113, SEQ ID NO: 117, SEQ ID NO: 119, SEQ ID NO: 131, SEQ ID NO: 133, SEQ ID NO: 135, SEQ ID NO: 137, SEQ ID NO: 183, SEQ ID NO: 193, SEQ ID NO: 197, SEQ ID NO: 199 or SEQ ID NO: 201, or b) nucleic acid sequences which, as the result of the degeneracy of the genetic code, can be derived from the amino acid sequences shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 112, SEQ ID NO: 114, SEQ ID NO: 118, SEQ ID NO: 120, SEQ ID NO: 132, SEQ ID NO: 134, SEQ ID NO: 136, SEQ ID NO: 138, SEQ ID NO: 184, SEQ ID NO: 194, SEQ ID NO: 198, SEQ ID NO: 200 or SEQ ID NO: 202, or c) derivatives of the nucleic acid sequence shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 111, SEQ ID NO: 113, SEQ ID NO: 117, SEQ ID NO: 119, SEQ ID NO: 131, SEQ ID NO: 133, SEQ ID NO: 135, SEQ ID NO: 137, SEQ ID NO: 183, SEQ ID NO: 193, SEQ ID NO: 197, SEQ ID NO: 199 or SEQ ID NO: 201, which encode polypeptides with at least 40% identity at the amino acid level with SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 112, SEQ ID NO: 114, SEQ ID NO: 118, SEQ ID NO: 120, SEQ ID NO: 132, SEQ ID NO: 134, SEQ ID NO: 136, SEQ ID NO: 138, SEQ ID NO: 184, SEQ ID NO: 194, SEQ ID NO: 198, SEQ ID NO: 200 or SEQ ID NO: 202 and which have a Δ9-elongase, Δ6-desaturase, Δ8-desaturase, Δ6-elongase, Δ5-desaturase, Δ5-elongase or Δ4-desaturase activity.

Advantageously, the substituents $R^2$ or $R^3$ in the general formulae I and II independently of one another are saturated or unsaturated $C_{18}$-$C_{22}$-alkylcarbonyl; especially advantageously, are independently of one another $C_{18}$-, $C_{20}$- or $C_{22}$-alkylcarbonyl with at least two double bonds, advantageously with at least three, four, five or six double bonds, especially advantageously with at least four, five or six double bonds.

In a preferred embodiment of the process, a nucleic acid sequence which encodes polypeptides with ω3-desaturase activity, selected from the group consisting of:
a) a nucleic acid sequence with the sequence shown in SEQ ID NO: 87 or SEQ ID NO: 105, or
b) nucleic acid sequences which can be derived form the amino acid sequence shown in SEQ ID NO: 88 or SEQ ID NO: 106 as the result of the degeneracy of the genetic code, or
c) derivatives of the nucleic acid sequence shown in SEQ ID NO: 87 or SEQ ID NO: 105, which encode polypeptides with at least 60% identity at the amino acid level with SEQ ID NO: 88 or SEQ ID NO: 106 and which have ω3-desaturase activity is additionally introduced into the transgenic plant.

In a further preferred embodiment of the process, that a nucleic acid sequence which encodes polypeptides with Δ12-desaturase activity, selected from the group consisting of:
a) a nucleic acid sequence with the sequence shown in SEQ ID NO: 107, SEQ ID NO: 109 or SEQ ID NO: 195, or
b) nucleic acid sequences which, as the result of the degeneracy of the genetic code, can be derived from the amino acid sequence shown in SEQ ID NO: 108, SEQ ID NO: 110 or SEQ ID NO: 196, or
c) derivatives of the nucleic acid sequence shown in SEQ ID NO: 107, SEQ ID NO: 109 or SEQ ID NO: 195, which encode polypeptides with at least 60% at the amino acid level with SEQ ID NO: 108, SEQ ID NO: 110 or SEQ ID NO: 196 and which have Δ12-desaturase activity is additionally introduced into the transgenic plant.

These abovementioned Δ12-desaturase sequences can be used alone or in combination with ω3-desaturase sequences together with the nucleic acid sequences used in the process which encode Δ9-elongases, Δ6-desaturases, Δ8-desaturases, Δ6-elongases, Δ5-desaturases, Δ5-elongases or Δ4-desaturases.

Table 1 shows the nucleic acid sequences, the organism of origin and the sequence ID number.

| No. | Organism | Activity | Sequence number |
|---|---|---|---|
| 1. | Euglena gracilis | Δ8-Desaturase | SEQ ID NO: 1 |
| 2. | Isochrysis galbana | Δ9-Elongase | SEQ ID NO: 3 |
| 3. | Phaeodactylum tricornutum | Δ5-Desaturase | SEQ ID NO: 5 |
| 4. | Ceratodon purpureus | Δ5-Desaturase | SEQ ID NO: 7 |
| 5. | Physcomitrella patens | Δ5-Desaturase | SEQ ID NO: 9 |
| 6. | Thraustrochytrium sp. | Δ5-Desaturase | SEQ ID NO: 11 |
| 7. | Mortierella alpina | Δ5-Desaturase | SEQ ID NO: 13 |
| 8. | Caenorhabditis elegans | Δ5-Desaturase | SEQ ID NO: 15 |
| 9. | Borago officinalis | Δ6-Desaturase | SEQ ID NO: 17 |
| 10. | Ceratodon purpureus | Δ6-Desaturase | SEQ ID NO: 19 |
| 11. | Phaeodactylum tricornutum | Δ6-Desaturase | SEQ ID NO: 21 |
| 12. | Physcomitrella patens | Δ6-Desaturase | SEQ ID NO: 23 |
| 13. | Caenorhabditis elegans | Δ6-Desaturase | SEQ ID NO: 25 |
| 14. | Physcomitrella patens | Δ6-Elongase | SEQ ID NO: 27 |
| 15. | Thraustrochytrium sp. | Δ6-Elongase | SEQ ID NO: 29 |
| 16. | Phytophtora infestans | Δ6-Elongase | SEQ ID NO: 31 |
| 17. | Mortierella alpina | Δ6-Elongase | SEQ ID NO: 33 |
| 18. | Mortierella alpina | Δ6-Elongase | SEQ ID NO: 35 |
| 19. | Caenorhabditis elegans | Δ6-Elongase | SEQ ID NO: 37 |
| 20. | Euglena gracilis | Δ4-Desaturase | SEQ ID NO: 39 |
| 21. | Thraustrochytrium sp. | Δ4-Desaturase | SEQ ID NO: 41 |
| 22. | Thalassiosira pseudonana | Δ5-Elongase | SEQ ID NO: 43 |
| 23. | Thalassiosira pseudonana | Δ6-Elongase | SEQ ID NO: 45 |
| 24. | Crypthecodinium cohnii | Δ5-Elongase | SEQ ID NO: 47 |
| 25. | Crypthecodinium cohnii | Δ5-Elongase | SEQ ID NO: 49 |
| 26. | Oncorhynchus mykiss | Δ5-Elongase | SEQ ID NO: 51 |
| 27. | Oncorhynchus mykiss | Δ5-Elongase | SEQ ID NO: 53 |
| 28. | Thalassiosira pseudonana | Δ5-Elongase | SEQ ID NO: 59 |
| 29. | Thalassiosira pseudonana | Δ5-Elongase | SEQ ID NO: 61 |
| 30. | Thalassiosira pseudonana | Δ5-Elongase | SEQ ID NO: 63 |
| 31. | Thraustrochytrium aureum | Δ5-Elongase | SEQ ID NO: 65 |
| 32. | Ostreococcus tauri | Δ5-Elongase | SEQ ID NO: 67 |
| 33. | Ostreococcus tauri | Δ6-Elongase | SEQ ID NO: 69 |
| 34. | Primula farinosa | Δ6-Desaturase | SEQ ID NO: 71 |
| 35. | Primula vialii | Δ6-Desaturase | SEQ ID NO: 73 |
| 36. | Ostreococcus tauri | Δ5-Elongase | SEQ ID NO: 75 |
| 37. | Ostreococcus tauri | Δ5-Elongase | SEQ ID NO: 77 |
| 38. | Ostreococcus tauri | Δ5-Elongase | SEQ ID NO: 79 |
| 39. | Ostreococcus tauri | Δ6-Elongase | SEQ ID NO: 81 |
| 40. | Thraustrochytrium sp. | Δ5-Elongase | SEQ ID NO: 83 |
| 41. | Thalassiosira pseudonana | Δ5-Elongase | SEQ ID NO: 85 |
| 42. | Phytophtora infestans | ω3-Desaturase | SEQ ID NO: 87 |
| 43. | Ostreococcus tauri | Δ6-Elongase | SEQ ID NO: 89 |
| 44. | Ostreococcus tauri | Δ5-Elongase | SEQ ID NO: 91 |
| 45. | Ostreococcus tauri | Δ5-Elongase | SEQ ID NO: 93 |
| 46. | Ostreococcus tauri | Δ4-Desaturase | SEQ ID NO: 95 |
| 47. | Thalassiosira pseudonana | Δ6-Desaturase | SEQ ID NO: 97 |
| 48. | Thalassiosira pseudonana | Δ5-Desaturase | SEQ ID NO: 99 |
| 49. | Thalassiosira pseudonana | Δ5-Desaturase | SEQ ID NO: 101 |
| 50. | Thalassiosira pseudonana | Δ4-Desaturase | SEQ ID NO: 103 |
| 51. | Thalassiosira pseudonana | ω3-Desaturase | SEQ ID NO: 105 |
| 52. | Ostreococcus tauri | Δ12-Desaturase | SEQ ID NO: 107 |
| 53. | Thalassiosira pseudonana | Δ12-Desaturase | SEQ ID NO: 109 |
| 54. | Ostreococcus tauri | Δ6-Elongase | SEQ ID NO: 111 |
| 55. | Ostreococcus tauri | Δ5-Elongase | SEQ ID NO: 113 |
| 56. | Xenopus laevis (BC044967) | Δ5-Elongase | SEQ ID NO: 117 |
| 57. | Ciona intestinalis (AK112719) | Δ5-Elongase | SEQ ID NO: 119 |
| 58. | Euglena gracilis | Δ5-Elongase | SEQ ID NO: 131 |
| 59. | Euglena gracilis | Δ5-Elongase | SEQ ID NO: 133 |
| 60. | Arabidopsis thaliana | Δ5-Elongase | SEQ ID NO: 135 |
| 61. | Arabidopsis thaliana | Δ5-Elongase | SEQ ID NO: 137 |
| 62. | Phaeodactylum tricornutum | Δ6-Elongase | SEQ ID NO: 183 |
| 63. | Phytium irregulare | Δ6-Desaturase | SEQ ID NO: 193 |
| 64. | Calendula officinalis | Δ12-Desaturase | SEQ ID NO: 195 |
| 65. | Ostreococcus tauri | Δ5-Elongase | SEQ ID NO: 197 |
| 66. | Ostreococcus tauri | Δ6-Elongase | SEQ ID NO: 199 |
| 67. | Ostreococcus tauri | Δ6-Desaturase | SEQ ID NO: 201 |

In a further embodiment of the invention, a process to be developed for the production of large amounts of polyunsaturated fatty acids, specifically ARA and EPA, in a transgenic plant. This process is also suitable for the production of DHA. Thus, ARA, EPA, DHA or their mixtures can be produced in the process. A further embodiment of the invention is thus a process for the compounds of the general formula I

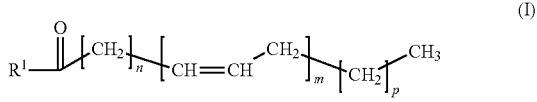

(I)

in transgenic plants, the process comprising:
a) introducing, into a plant, at least one nucleic acid sequence which encodes a polypeptide with a Δ6-desaturase activity and is selected from the group consisting of:
   i) a nucleic acid with the sequence shown in SEQ ID NO: 193 or SEQ ID NO: 201,
   ii) nucleic acid sequences which encode the amino acid sequence shown in SEQ ID NO: 194 or SEQ ID NO: 202,
   iii) nucleic acid sequences which hybridize under stringent conditions with the complementary strand of the nucleic acid sequence shown in SEQ ID NO: 193 or SEQ ID NO: 201, and
   iv) nucleic acid sequences which have at least 60% identity with the sequence shown in SEQ ID NO: 193 or SEQ ID NO: 201,
b) introducing, into a plant, at least one nucleic acid sequence which encodes a polypeptide with a Δ6-elongase activity and is selected from the group consisting of:
   i) a nucleic acid with the sequence shown in SEQ ID NO: 27 or SEQ ID NO: 199,
   ii) nucleic acid sequences which encode the amino acid sequence shown in SEQ ID NO: 28 or SEQ ID NO: 200,
   iii) nucleic acid sequences which hybridize under stringent conditions with the complementary strand of the nucleic acid sequence shown in SEQ ID NO: 27 or SEQ ID NO: 199, and
   iv) nucleic acid sequences which have at least 60% identity with the sequence shown in SEQ ID NO: 27 or SEQ ID NO: 199,
c) introducing, into a plant, at least one nucleic acid sequence which encodes a polypeptide with a Δ5-desaturase activity and is selected from the group consisting of:
   i) a nucleic acid with the sequence shown in SEQ ID NO: 11,
   ii) nucleic acid sequences which encode the amino acid sequence shown in SEQ ID NO: 12,
   iii) nucleic acid sequences which hybridize under stringent conditions with the complementary strand of the nucleic acid sequence shown in SEQ ID NO: 11, and
   iv) nucleic acid sequences which have at least 60% identity with the sequence shown in SEQ ID NO: 11, where the variables and substituents in the formula I have the meaning given above.

The nucleic acid sequences which can be used in the process are described in WO 02/26946 (Δ5-desaturase from *Thraustochytrium* ssp., SEQ ID NO: 11 and Δ6-desaturase from *Phytium irregulare*, SEQ ID NO: 193) and in WO 01/59128 (Δ6-elongase from *Physcomitrella patens*, SEQ ID NO: 27), which is expressly referred to here. However, in these cases, the formation of ARA and EPA was studied either not in transgenic plants, but only in microorganisms, or else no increase ARA and EPA synthesis was detected in the transgenic plants. Moreover, the nucleic acids according to the invention were not combined, in these applications, with nucleic acids which encode other enzymes of the fatty acid biosynthetic pathway.

Surprisingly, it has now been found that the coexpression of the nucleic acids with the sequences shown in SEQ ID NO: 11, 27, 193, 199 and 201 leads, in transgenic plants, to a greatly increased ARA content to up to more than 8%, advantageously up to more than 10%, 11%, 12%, 13%, 14%, 15%, 16%, 17%, 18%, 19% or 20%, especially advantageously to more than 21%, 22%, 23%, 24% or 25%, based on the total lipid content of the plant (cf. Table 2, Table 3, Table 4 and FIG. 31). The abovementioned percentages are percent by weight.

To further increase the yields in the process described for the production of oils and/or triglycerides with a content of polyunsaturated fatty acids, especially ARA, EPA or DHA or their mixtures, which is advantageously increased in comparison with oils and/or triglycerides from wild-type plants, it may be advantageous to increase the amount of the starting material for the fatty acid biosynthesis. This can be achieved for example by introducing a nucleic acid which encodes a polypeptide with the activity of a Δ12-desaturase, and coexpressing it in the organism.

This is especially advantageously in oil-producing organisms such as the family Brassicaceae, such as the genus *Brassica*, for example oilseed rape, turnip rape or Indian mustard; the family Elaeagnaceae, such as the genus *Elaeagnus*, for the example the genus and species *Olea europaea* or the family Fabaceae, such as the genus *Glycine*, for example the genus and species *Glycine max*, which has a high oleic acid content, but only a low linoleic acid content (Mikoklajczak et al., Journal of the American Oil Chemical Society, 38, 1961, 678-681).

This is why, in a preferred embodiment of the present invention, a nucleic acid sequence which encodes a polypeptide with Δ12-desaturase activity is additionally introduced into the transgenic plant.

Especially preferably, this nucleic acid sequence is selected from the group consisting of:
a) a nucleic acid sequence with the sequence shown in SEQ ID NO: 195,
b) nucleic acid sequences which encode the amino acid sequence shown in SEQ ID NO: 196,
c) nucleic acid sequences which hybridize under stringent conditions with the complementary strand of the nucleic acid sequence shown in SEQ ID NO: 195, and
d) nucleic acid sequences which have at least 60% identity with the sequence shown in SEQ ID NO: 195.

The nucleic acid sequence with the SEQ ID NO: 195 is derived from *Calendula officinalis* and described in WO 01/85968, the disclosure of which is likewise incorporated in the present application by reference.

The Δ12-desaturases used in the process according to the invention advantageously convert oleic acid (C18:1$^{\Delta9}$) into linoleic acid (C18:2$^{\Delta9,12}$) or C18:2$^{\Delta6,9}$ into C18:3$^{\Delta6,9,12}$ (gamma-linolenic acid=GLA), the starting materials for the synthesis of ARA, EPA and DHA. The Δ12-desaturases advantageously convert fatty acids bound to phospholipids or CoA-fatty acid esters, advantageously bound to CoA-fatty acid esters. If an elongation step has taken place beforehand, this advantageously leads to higher yields of synthetic products since, as a rule, elongation takes place at CoA-fatty acid esters, while desaturation predominantly takes place at the phospholipid or at the triglycerides. An exchange between the CoA-fatty acid esters and the phospholipids or triglycerides, which would require a further, potentially limiting, enzyme reaction, is thus not required.

The additional expression of the Δ12-desaturase in the transgenic plants leads to a further increase in the ARA content up to more than 10%, 11%, 12%, 13%, 14%, 15%, 16%, 17%, 18%, 19% and 20%, especially advantageously to more than 21%, 22%, 23%, 24% or 25%, based on the total lipid content of the plant (cf. Tables 3 and 4 and FIG. 32). The abovementioned percentages are percent by weight.

Further nucleic acid sequences which encode a polypeptide with a Δ5-elongase activity can advantageously be introduced into the plants in the process according to the invention.

Preference is given to those nucleic acid sequences which encode a Δ5-elongase activity is chosen from the group consisting of:

a) a nucleic acid sequence was the sequence shown in SEQ ID NO: 43, SEQ ID NO: 47, SEQ ID NO: 49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 75, SEQ ID NO: 77, SEQ ID NO: 79, SEQ ID NO: 83, SEQ ID NO: 85, SEQ ID NO: 113, SEQ ID NO: 117, SEQ ID NO: 119, SEQ ID NO: 131, SEQ ID NO: 133, SEQ ID NO: 135, SEQ ID NO: 137 or SEQ ID NO: 197, b) nucleic acid sequences which encode the amino acid sequence shown in SEQ ID NO: 44, SEQ ID NO: 48, SEQ ID NO: 50, SEQ ID NO: 52, SEQ ID NO: 54, SEQ ID NO: 60, SEQ ID NO: 62, SEQ ID NO: 64, SEQ ID NO: 66, SEQ ID NO: 68, SEQ ID NO: 76, SEQ ID NO: 78, SEQ ID NO: 80, SEQ ID NO: 81, SEQ ID NO: 86, SEQ ID NO: 114, SEQ ID NO: 118, SEQ ID NO: 120, SEQ ID NO: 132, SEQ ID NO: 134, SEQ ID NO: 136, SEQ ID NO: 138 or SEQ ID NO: 198, c) nucleic acid sequences which hybridize under stringent conditions with the complementary strand of the nucleic acid sequence shown in SEQ ID NO: 43, SEQ ID NO: 47, SEQ ID NO: 49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 75, SEQ ID NO: 77, SEQ ID NO: 79, SEQ ID NO: 83, SEQ ID NO: 85, SEQ ID NO: 113, SEQ ID NO: 117, SEQ ID NO: 119, SEQ ID NO: 131, SEQ ID NO: 133, SEQ ID NO: 135, SEQ ID NO: 137 or SEQ ID NO: 197, and d) nucleic acid sequences which have at least 60% identity with the sequence shown in SEQ ID NO: 43, SEQ ID NO: 47, SEQ ID NO:49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 75, SEQ ID NO: 77, SEQ ID NO: 79, SEQ ID NO: 83, SEQ ID NO: 85, SEQ ID NO: 113, SEQ ID NO: 117, SEQ ID NO: 119, SEQ ID NO: 131, SEQ ID NO: 133, SEQ ID NO: 135, SEQ ID NO: 137 or SEQ ID NO: 197.

In a preferred embodiment of the process, the Δ5-elongase genes are expressed under the control of a seed-specific promoter.

In a further advantageous embodiment of the process, all nucleic acid sequences are introduced into the plants on a shared recombinant nucleic acid molecule, it being possible for each nucleic acid sequence to be under the control of its own promoter and it being possible for this own promoter to take the form of a seed-specific promoter.

However, it is not only the nucleic acids detailed in the sequence listing which can successfully be employed in the invention to carry out the conversion; rather, even sequences which deviate to a certain degree from these sequences and which encode proteins with the essentially identical enzymatic activity can be employed. These take the form of nucleic acids which have a certain degree of identity or homology with the sequences specified in the sequence listing. An essentially identical enzymatic activity denotes proteins which have at least 20%, 30%, 40%, 50% or 60%, advantageously at least 70%, 80%, 90% or 95%, especially advantageously at least 96%, 97%, 98% or 99% of the enzymatic activity of the wild-type enzymes.

In order to determine the percentage of homology (=identity) of two amino acid sequences or of two nucleic acids, the sequences are written one under the other (for example, gaps may be introduced into the sequence of a protein or of a nucleic acid in order to generate optimal alignment with the other protein or the other nucleic acid). Then, the amino acid radicals or nucleotides at the corresponding amino acid positions or nucleotide positions are compared. If a position in a sequence is occupied by the same amino acid radical or the same nucleotide as the corresponding position in the other sequence, then the molecules are homologous at this position (i.e. amino acid or nucleic acid "homology" as used in the present context corresponds to amino acid or nucleic acid "identity"). The percentage of homology between the two sequences is a function of the number of positions which the sequences share (i.e. % homology=number of identical positions/total number of positions×100). The terms homology and identity are therefore to be considered as synonymous.

The homology was calculated over the entire amino acid or nucleic acid sequence region. To compare various sequences, the skilled worker has available a series of programs which are based on various algorithms. The algorithms of Needleman and Wunsch or Smith and Waterman give particularly reliable results. The program PileUp (J. Mol. Evolution., 25, 351-360, 1987, Higgins et al., CABIOS, 5 1989: 151-153) or the programs Gap and BestFit [Needleman and Wunsch (J. Mol. Biol. 48; 443-453 (1970) and Smith and Waterman (Adv. Appl. Math. 2; 482-489 (1981)], which are part of the GCG software packet [Genetics Computer Group, 575 Science Drive, Madison, Wis., USA 53711 (1991)], were used to carry out the sequence comparisons. The sequence homology data given above in percent were determined over the entire sequence region using the program GAP with the following settings: Gap Weight: 50, Length Weight: 3, Average Match: 10.000 and Average Mismatch: 0.000. Unless otherwise specified, these settings were always used as standard settings for sequence comparisons.

The skilled worker will recognize that DNA sequence polymorphisms which lead to modifications of the amino acid sequence of SEQ ID NO: 12, 28, 194, 196, 198, 200 and/or 202 may occur within a population. These natural variants usually cause a variance of from 1 to 5% in the nucleotide sequence of the Δ12-desaturase, Δ6-desaturase, Δ5-desaturase, Δ5-elongase and/or Δ6-elongase gene. The scope of the invention is to comprise each and all of these nucleotide variation(s) and resulting amino acid polymorphisms in the Δ12-desaturase, Δ6-desaturase, Δ5-desaturase, Δ5-elongase and/or Δ6-elongase which are the result of natural variation and which do not essentially modify the enzymatic activity.

Essential enzymatic activity of the Δ12-desaturase, Δ6-desaturase, Δ6-elongase, Δ5-elongase or Δ5-desaturase used in the process according to the invention is understood as meaning that they retain an enzymatic activity of at least 10%, preferably of at least 20%, especially preferably of at least 30%, 40%, 50% or at least 60% and most preferably at least 70%, 80%, 90%, 95%, 96%, 97%, 98% or 99% in comparison with the proteins/enzymes encoded by the sequence and its derivatives and that they are thus capable of participating in the metabolism of compounds which are required for the synthesis of fatty acids, fatty acid esters such as diacylglycerides and/or triacylglycerides in a plant or plant cell or in the transport of molecules across membranes, meaning $C_{18}$-, $C_{20}$- or $C_{22}$-carbon chains in the fatty acid molecule with double bonds at at least two, advantageously three, four or five, positions.

Likewise, the scope of the invention comprises nucleic acid molecules which hybridize under stringent conditions with the complementary strand of the Δ12-desaturase, Δ6-desaturase, Δ5-desaturase, Δ5-elongase and/or Δ6-elongase nucleic acids used. The term "hybridizes under stringent conditions" as used in the present context is to describe hybridization and washing conditions under which nucleotide sequences with at least 60% homology to one another usually remain hybridized with one another. Conditions are preferably such that sequences with at least approximately 65%, 70%, 80% or 90%, preferably at least approximately 91%, 92%, 93%, 94% or 95%, and especially preferably at least approximately 96%, 97%, 98%, 99% or more homology to one another usually remain hybridized to one another. These stringent conditions are known to the skilled worker and described, for example, in Current Protocols in Molecular Biology, John Wiley & Sons, N. Y. (1989), 6.3.1-6.3.6.

A preferred, nonlimiting, example of stringent hybridization conditions is hybridizations in 6× sodium chloride/sodium citrate (=SSC) at approximately 45° C., followed by one or more washing steps in 0.2×SSC, 0.1% SDS at 50 to 65° C. The skilled worker knows that these hybridization conditions differ depending on the type of nucleic acid and, for example when organic solvents are present, regarding temperature and buffer concentration. Under "standard hybridization conditions", for example, the hybridization temperature is, depending on the type of nucleic acid, between 42° C. and 58° C. in aqueous buffer with a concentration of 0.1 to 5×SSC (pH 7.2). If organic solvents, for example 50% formamide, are present in the abovementioned buffer, the temperature under standard conditions is approximately 42° C. Preferably the hybridization conditions for DNA:DNA hybrids, for example, are 0.1×SSC and 20° C. to 45° C., preferably 30° C. to 45° C. Preferably the hybridization conditions for DNA:RNA hybrids are, for example, 0.1×SSC and 30° C. to 55° C., preferably 45° C. to 55° C. The abovementioned hybridization temperatures are determined for a nucleic acid with approximately 100 bp (=base pairs) in length and with a G+C content of 50% in the absence of formamide. The skilled worker knows how to determine the required hybridization conditions on the basis of textbooks such as Sambrook et al., "Molecular Cloning", Cold Spring Harbor Laboratory, 1989; Hames and Higgins (Eds.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford.

By introducing one or more nucleotide substitutions, additions or deletions into a nucleotide sequence, it is possible to generate an isolated nucleic acid molecule which encodes a Δ12-desaturase, Δ6-desaturase, Δ5-desaturase, Δ5-elongase and/or Δ6-elongase with one or more amino acid substitutions, additions or deletions. Mutations can be introduced into one of the sequences by means of standard techniques, such as site-specific mutagenesis and PCR-mediated mutagenesis. It is preferred to generate conservative amino acid substitutions in one or more of the above nonessential amino acid radicals. In a "conservative amino acid substitution", the amino acid radical is replaced by an amino acid radical with a similar side chain. Families of amino acid radicals with similar side chains have been defined in the art. These families comprise amino acids with basic side chains (for example lysine, arginine, histidine), acidic side chains (for example aspartic acid, glutamic acid), uncharged polar side chains (for example glycine, asparagine, glutamine, serine, threonine, tyrosine, cysteine), unpolar side chains (for example alanine, valine, leucine, isoleucine, proline, phenylalanine, methionine, tryptophan), beta-branched side chains (for example threonine, valine, isoleucine) and aromatic side chains (for example tyrosine, phenylalanine, tryptophan, histidine). A predicted nonessential amino acid radical in a Δ12-desaturase, Δ6-desaturase, Δ5-desaturase, Δ5-elongase or Δ6-elongase is thus preferably replaced by another amino acid radical from the same family of side chains.

In another embodiment, the mutations can, alternatively, be introduced randomly over all or part of the sequence encoding the Δ12-desaturase, Δ6-desaturase, Δ5-desaturase, Δ5-elongase or Δ6-elongase, for example by saturation mutagenesis, and the resulting mutants can be screened by recombinant expression for the hereindescribed Δ12-desaturase, Δ6-desaturase, Δ5-desaturase, Δ5-elongase or Δ6-elongase activity in order to identify mutants which have retained the Δ12-desaturase, Δ6-desaturase, Δ5-desaturase, Δ5-elongase or Δ6-elongase activity.

The polyunsaturated fatty acids produced in the process according to the invention advantageously comprise at least two, preferably three, four, five or six, double bonds. The fatty acids especially preferably comprise four, five or six double bonds. Fatty acids produced in the process preferably have a length of 20 C or 22 C atoms.

Saturated fatty acids are preferably reacted to a minor degree with the nucleic acids used in the process, or not at all. "A minor degree" is understood as meaning that, in comparison with polyunsaturated fatty acids, the saturated fatty acids are reacted with less than 5%, preferably with less than 3%, especially preferably with less than 2%, most preferably with less than 1, 0.5, 0.25 or 0.125% of the activity. The fatty acids produced may constitute the only product of the process or else may be present in a fatty acid mixture.

The polyunsaturated fatty acids produced in the process are advantageously bound in membrane lipids and/or triacylglycerides, but may also occur in the organisms as free fatty acids or else bound in the form of other fatty acid esters. In this context, they may be present as "pure products" or else advantageously in the form of mixtures of various fatty acids or mixtures of different glycerides. The various fatty acids which are bound in the triacylglycerides can be derived from short-chain fatty acids with 4 to 6 C atoms, medium-chain fatty acids with 8 to 12 C atoms or long-chain fatty acids with 14 to 24 C atoms, preferred are the long-chain fatty acids, especially preferred are the long-chain fatty acids LCPUFAs of $C_{18}$-, $C_{20}$- and/or $C_{22}$-fatty acids, very especially preferred are the long-chain fatty acids LCPUFAs of $C_{20}$- and/or $C_{22}$-fatty acids such as ARA, EPA, DHA or their combination.

The process according to the invention advantageously yields fatty acid esters with polyunsaturated $C_{18}$-, $C_{20}$- and/or $C_{22}$-fatty acid molecules with at least two double bonds in the fatty acid ester, advantageously with at least three, four, five or six double bonds in the fatty acid ester, especially advantageously four, five or six double bonds in the fatty acid ester, very especially advantageously at least five or six double bonds in the fatty acid ester. This advantageously leads to the synthesis of linoleic acid (=LA, C18:$2^{\Delta 9,12}$), γ-linolenic acid (=GLA, C18:$3^{\Delta 6,9,12}$), stearidonic acid (=SDA, C18:$4^{\Delta 6,9,12,15}$), dihomo-γ-linolenic acid (=DGLA, 20:$3^{\Delta 8,11,14}$), ω3-eicosatetraenoic acid (=ETA, C20:$4^{\Delta 5,8,11,14}$), arachidonic acid (ARA, C20:$4^{\Delta 5,8,11,14}$), eicosapentaenoic acid (EPA, C20:4$^{\Delta 5,8,11,14}$) or mixtures of these, ω3-eicosapentaenoic acid (=ETA, C20:4$^{\Delta 5,8,11,14,17}$), arachidonic acid (ARA, C20:4$^{\Delta 5,8,11,14}$), eicosapentaenoic acid (EPA, C20:5$^{\Delta 5,8,11,14,17}$), ω6-docosapentaenoic acid (C22:5$^{\Delta 4,7,10,13,16}$), ω6-docosapentaenoic acid (C22:4$^{\Delta 7,10,13,16}$), ω3-docosapentaenoic acid (=DPA, C22:5$^{\Delta 7,10,13,16,19}$), docosahexaenoic acid (=DHA, C22:6$^{\Delta 4,7,10,13,16,19}$) or their mixtures are preferably produced, and ARA, EPA and/or DHA are very especially produced. ω3-Fatty acids such as EPA and/or DHA, preferably DHA, are advantageously produced.

The fatty acid esters with polyunsaturated $C_{18}$-, $C_{20}$- and/or $C_{22}$-fatty acid molecules, advantageously with polyunsaturated $C_{20}$- and/or $C_{22}$-fatty acid molecules, can be isolated in the form of an oil or lipid, for example in the form of compounds such as sphingolipids, phosphoglycerides, lipids, glycolipids such as glycosphingolipids, phospholipids such as phosphatidylethanolamine, phosphatidylcholine, phosphatidylserine, phosphatidylglycerol, phosphatidylinositol or diphosphatidylglycerol, monoacylglycerides, diacylglycerides, triacylglycerides or other fatty acid esters such as the acetyl-coenzyme A esters which comprise the polyunsaturated fatty acids with at least two, three, four, five or six, preferably four, five or six, especially preferably five or six, double bonds, from the plants which were used for the preparation of the fatty acid esters. Preferably, they are isolated in the form of their diacylglycerides, triacylglycerides and/or in the form of phosphatidylcholine, especially preferably in the form of the triacylglycerides. In addition to these esters, the polyunsaturated fatty acids are also present in the plants as free fatty acids or bound in other compounds. As a rule, the various abovementioned compounds (fatty acid esters and free fatty acids) are present in the organisms with an approximate distribution of 80 to 90% by weight of triglycerides, 2 to 5% by weight of diglycerides, 5 to 10% by weight of monoglycerides, 1 to 5% by weight of free fatty acids, 2 to 8% by weight of phospholipids, the total of the various compounds amounting to 100% by weight.

In the method(s) according to the invention (for the purposes of the invention and the disclosure shown herein, the singular is to comprise the plural and vice versa), the LCPUFAs produced are produced in a content of at least 3, 5, 6, 7 or 8% by weight, advantageously at least 9, 10, 11, 12, 13, 14 or 15% by weight, preferably at least 16, 17, 18, 19 or 20% by weight, especially preferably at least 21, 22, 23, 24 or 25% by weight, very especially preferably at least 26, 27, 28, 29 or 30% by weight based on the total fatty acids in the transgenic organisms, advantageously in the seeds of the transgenic plants. Here, $C_{18}$- and/or $C_{20}$-fatty acids which are present in the host organisms are advantageously converted into the corresponding products such as ARA, EPA, DPA or DHA, to mention but a few by way of example, at the rate of at least 10%, advantageously at least 20%, especially advantageously at least 30%, very especially advantageously at least 40%. The fatty acids are advantageously produced in bound form.

Polyunsaturated $C_{20}$-fatty acids with four or five double bonds in the molecule are advantageously produced in the process in a content of all such fatty acids together of at least 15, 16, 17, 18, 19, or 20% by weight, advantageously at least 21, 22, 23, 24 or 25% by weight, especially advantageously at least 26, 27, 28, 29 or 30% by weight based on the total fatty acids in the seeds of the transgenic plants.

Polyunsaturated $C_{20}$- and/or $C_{22}$-fatty acids with four, five or six double bonds in the molecule are advantageously produced in the process in a content of all such fatty acids together of at least 15, 16, 17, 18, 19, or 20% by weight, advantageously at least 21, 22, 23, 24 or 25% by weight, especially advantageously at least 26, 27, 28, 29 or 30% by weight, very especially advantageously at least 31, 32, 33, 34 or 35% by weight based on the total fatty acids in the seeds of the transgenic plants.

ARA is produced in the process according to the invention in a content of at least 3, 5, 6, 7, 8, 9 or 10% by weight, advantageously at least 11, 12, 13, 14 or 15% by weight, preferably at least 16, 17, 18, 19 or 20% by weight, especially preferably at least 21, 22, 23, 24 or 25% by weight, most preferably at least 26% by weight, based on the total lipid content in the seeds of the transgenic plants.

EPA is produced in the process according to the invention in a content of at least 0.2, 0.3, 0.4, 0.5, 0.6, 0.7, 0.8, 0.9 or 1% by weight, advantageously at least 2, 3, 4 or 5% by weight, preferably at least 6, 7, 8, 9 or 10% by weight, especially preferably at least 11, 12, 13, 14 or 15% by weight and most preferably at least 16% by weight, based on the total lipid content in the seeds of transgenic plants.

DHA is produced in the process according to the invention in a content of at least 0.01 or 0.02% by weight, advantageously at least 0.03 or 0.05% by weight, advantageously at least 0.09 or 0.1% by weight, especially preferably at least 0.2 or 0.3% by weight and most preferably at least 0.35% by weight, based on the total lipid content in the seeds of the transgenic plants.

It is possible, with the aid of the nucleic acids used in the process according to the invention, for these unsaturated fatty acids to be positioned at the sn1, sn2 and/or sn3 position of the triglycerides which have advantageously been produced. Since in the process according to the invention the starting compounds linoleic acid (C18:2) and linolenic acid (C18:3) pass through a plurality of reaction steps, the end product of the process, such as, for example, arachidonic acid (ARA), eicosapentaenoic acid (EPA), ω6-docosapentaenoic acid or DHA, are not obtained as absolutely pure products, small traces of the precursors are also always present in the end product. If, for example, both linoleic acid and linolenic acid are present in the starting organism, or the starting plants, the end product, such as ARA, EPA or DHA, are present as mixtures. It is advantageous that, in the end product ARA or DHA, only minor amounts of the in each case other end product should be present. This is why, in a DHA-comprising lipid and/or oil, less than 15, 14, 13, 12 or 11% by weight, advantageously less than 10, 9, 8, 7, 6 or 5% by weight, especially advantageously less than 4, 3, 2 or 1% by weight, of EPA and/or ARA should be present. This is why, in a EPA-comprising lipid and/or oil, less than 15, 14, 13, 12 or 11% by weight, advantageously less than 10, 9, 8, 7, 6 or 5% by weight, especially advantageously less than 4, 3, 2 or 1% by weight, of ARA should be present. This is also why less than 15, 14, 13, 12 or 11% by weight, advantageously less than 10, 9, 8, 7, 6 or 5% by weight, especially advantageously less than 4, 3, 2 or 1% by weight of EPA and/or DHA should be present in an ARA-comprising lipid and/or oil.

However, mixtures of different polyunsaturated $C_{20}$- and/or $C_{22}$-fatty acids in one product may also be desirable. In such cases, DHA-comprising lipids and/or oils may comprise at least 1, 2, 3, 4 or 5% by weight of ARA and/or EPA, advantageously at least 6, 7 or 8% by weight, especially advantageously at least 9, 10, 11, 12, 13, 14 or 15% by weight, very especially advantageously at least 16, 17, 18, 19, 20, 21, 22, 23, 24 or 25% by weight, based on the total lipid content in the seeds of the transgenic plants.

The precursors should advantageously not amount to more than 20% by weight, preferably not to more than 15% by weight, especially preferably not to more than 10% by weight, very especially preferably not to more than 5% by weight, based on the amount of the end product in question. Advantageously, only ARA, EPA or only DHA, bound or as free acids, are produced as end products in the process of the invention in a transgenic plant. If the compounds ARA, EPA and DHA are produced simultaneously, they are advantageously produced in a ratio of at least 1:1:2 (EPA:ARA: DHA), advantageously at least 1:1:3, preferably 1:1:4, especially preferably 1:1:5. If the compounds ARA and EPA are produced simultaneously, they are advantageously produced, in the plant, in a ratio of at least 1:6 (EPA:ARA), advantageously of at least 1:8, preferably of at least 1:10, especially preferably of at least 1:12.

Fatty acid esters or fatty acid mixtures produced by the process according to the invention advantageously comprise 6 to 15% of palmitic acid, 1 to 6% of stearic acid, 7-85% of oleic acid, 0.5 to 8% of vaccenic acid, 0.1 to 1% of arachic acid, 7 to 25% of saturated fatty acids, 8 to 85% of monounsaturated fatty acids and 60 to 85% of polyunsaturated fatty acids, in each case based on 100% and on the total fatty acid content of the organisms.

Moreover, the fatty acid esters or fatty acid mixtures which have been produced by the process of the invention advantageously comprise fatty acids selected from the group of the fatty acids erucic acid (13-docosaenoic acid), sterculic acid (9,10-methyleneoctadec-9-enoic acid), malvalic acid (8,9-methyleneheptadec-8-enoic acid, chaulmoogric acid (cyclopentenedodecanoic acid), furan fatty acid (9,12-epoxyoctadeca-9,11-dienoic acid), vernolic acid (9,10-epoxyoctadec-12-enoic acid), tariric acid (6-octadecynoic acid), 6-nonadecynoic acid, santalbic acid (t11-octadecen-9-ynoic acid), 6,9-octadecenynoic acid, pyrulic acid (t10-heptadecen-8-ynoic acid), crepenyninic acid (9-octadecen-12-ynoic acid), 13,14-dihydrooropheic acid, octadecen-13-ene-9,11-diynoic acid, petroselenic acid (cis-6-octadecenoic acid), 9c,12t-octadecadienoic acid, calendulic acid (8t10t12c-octadecatrienoic acid), catalpic acid (9t11t13c-octadecatrienoic acid), eleostearic acid (9c11t13t-octadecatrienoic acid), jacaric acid (8c10t12c-octadecatrienoic acid), punicic acid (9c11t13c-octadecatrienoic acid), parinaric acid (9c11t13t15c-octadecatetraenoic acid), pinolenic acid (all-cis-5,9,12-octadecatrienoic acid), laballenic acid (5,6-octadecadienallenic acid), ricinoleic acid (12-hydroxyoleic acid) and/or coriolic acid (13-hydroxy-9c,11t-octadecadienoic acid). The abovementioned fatty acids are, as a rule, advantageously only found in traces in the fatty acid esters or fatty acid mixtures produced by the process according to the invention, that is to say that, based on the total fatty acids, they occur to less than 30%, preferably to less than 25%, 24%, 23%, 22% or 21%, especially preferably to less than 20%, 15%, 10%, 9%, 8%, 7%, 6% or 5%, very especially preferably to less than 4%, 3%, 2% or 1%. In a further preferred form of the invention, these abovementioned fatty acids occur to less than 0.9%, 0.8%, 0.7%, 0.6% or 0.5%, especially preferably to less than 0.4%, 0.3%, 0.2%, 0.1%, based on the total fatty acids. The fatty acid esters or fatty acid mixtures produced by the process according to the invention advantageously comprise less than 0.1%, based on the total fatty acids, or no butyric acid, no cholesterol, no clupanodonic acid (=docosapentaenoic acid, $C22:5^{\Delta4,8,12,15,21}$) and no nisinic acid (tetracosahexaenoic acid, $C23:6^{\Delta3,8,12,15,18,21}$).

Owing to the nucleic acid sequences according to the invention or nucleic acid sequences used in the process according to the invention, an increase in the yield of polyunsaturated fatty acids, mainly ARA and EPA, but also DHA, of at least 50, 80 or 100%, advantageously at least 150, 200 or 250%, especially advantageously at least 300, 400, 500, 600, 700, 800 or 900%, very especially advantageously at least 1000, 1100, 1200, 1300, 1400 or 1500% in comparison with the nontransgenic starting plant, for example a plant such as *Brassica juncea, Brassica napus, Camelina sativa, Arabidopsis thanliana* or *Linum usitatissimum* when compared by means of GC analysis; see Examples.

Advantageously, as described above, the polyunsaturated $C_{20}$- and/or $C_{22}$-fatty acids with four, five or six double bonds in the molecule, which are produced in the process, will comprise in the seeds of plants which comprise only very small amounts of C12:0- or C14:0-fatty acids, or none at all. Even shorter saturated fatty acids, such as the fatty acids C4:0, C6:0, C8:0 or C10:0 should not be present in the lipid and/or oil or only in very small amounts. Only very small amounts are advantageously understood as amounts which, in GC analysis, are advantageously under 5, 4, 3, 2 or 1%, advantageously under 0.9, 0.8, 0.7, 0.6 or 0.5%, especially advantageously under 0.4, 0.3, 0.2 or 0.1%, very especially preferably under 0.09, 0.08, 0.07, 0.06, 0.05, 0.04, 0.03, 0.02 or 0.01 units area in the GC. The fatty acid C16:0 should advantageously be in a range of from 1 to 28% GC units area. The fatty acid C16:0 should advantageously be present in GC units area in amounts of less than 25%, 20%, 15% or 10%, advantageously less than 9%, 8%, 7%, 6% or 5%, especially advantageously less than 4%, 3%, 2% or 1% or not at all, in the lipids, oils and/or free fatty acids. The fatty acid C16:1 should advantageously amount to less than 1, 0.5, 0.4, 0.3, 0.2 or 0.1%, especially advantageously 0.09, 0.08, 0.07, 0.06, 0.05, 0.04, 0.03, 0.02 or 0.01 units area in the GC. Very especially preferably, the fatty acid C16:1 should not be present in the oils and/or lipids produced by the process. The same applies to the fatty acids C15:0, C17:0, C16:1$^{\Delta3}$trans, C16:4$^{\Delta4,7,19,13}$ and C18:5$^{\Delta3,6,9,12,15}$. Besides oleic acid (C18:1$^{\Delta9}$), the isomers (C18:1$^{\Delta7}$, 18:1$^{\Delta11}$) may also be present in the lipids, oils or free fatty acids. Advantageously in amounts of less than 5%, 4%, 3%, 2% or 1%, measured as units GC area. The fatty acids C20:0, C20:1, C24:0 and C24:1 should in each case be in the range of from 0 to 1%, 0 to 3% and 0 to 5%, respectively, units GC area. Furthermore, little dihomo-γ-linolenic acid (=DGLA) should be detectable in the GC analysis in units GC area in the seed oil and/or seed lipid. Little is understood as meaning less than 2, 1.9, 1.8, 1.7, 1.6 or 1.5%, advantageously less than 1.4, 1.3, 1.2, 1.1 or 1%, especially advantageously less than 0.9, 0.8, 0.7, 0.6, 0.5 or 0.4% in units GC area.

In a preferred embodiment of the process, DGLA and ARA should be produced in a ratio of from 1:1 up to 1:100, advantageously from 1:2 up to 1:80, especially advantageously from 1:3 up to 1:70, very especially from 1:5 up to 1:60.

In a further preferred embodiment, DGLA and EPA should be produced in a ratio of from 1:1 up to 1:100, advantageously from 1:2 up to 1:80, especially advantageously from 1:3 up to 1:70, very especially from 1:5 up to 1:60.

The lipids and/or oils produced in the process according to the invention should advantageously have a high unsaturated, advantageously polyunsaturated, fatty acid content of at least 30, 40 or 50% by weight, advantageously at least 60, 70 or 80% by weight, based on the total fatty acid content in the seeds of the transgenic plants.

All saturated fatty acids together should advantageously only amount to a small quantity in the plants preferably used in the process according to the invention. In this context, a small amount is understood as meaning an amount of less than 15%, 14%, 13%, 12%, 11% or 10%, preferably less than 9%, 8%, 7% or 6%, in units GC area.

Furthermore, the genes for the synthesis of the polyunsaturated fatty acids, which are used in the process and which have been introduced, in the process, via different processes, advantageously as host plant, should advantageously have a higher oil content than protein content in the seed, advantageous plants have an oil/protein content ratio of from 5:1, 4:1, 3:1, 2:1 or 1:1. In this context, the oil content based on the total weight of the seed should be in a range of 15-55%, advantageously between 25-50%, especially advantageously between 35-50%. Advantageous host plants used in the process should have a distribution of the unsaturated fatty acids such as oleic acid, linoleic acid and linolenic acid, which are the starting compounds in the process according to the invention for the synthesis of polyunsaturated fatty acids, in the sn1, sn2 and sn3 position of the triglyceride, as shown in Table 5 hereinbelow, where rows No. 1-7 represent different advantageous alternatives of such distributions. n.p. means not present.

TABLE 5

Plants with advantageous fatty acid distribution in the sn1, sn2 and sn3 position on the triglyceride

| | Oleic acid | | | Linoleic acid | | | α-Linolenic acid | | |
|---|---|---|---|---|---|---|---|---|---|
| No. | sn1 | sn2 | sn3 | sn1 | sn2 | sn3 | sn1 | sn2 | sn3 |
| 1. | 1 | 1 | 1 | 2 | 4 | 1 | n.p. | n.p. | n.p. |
| 2. | 1.4 | 2.2 | 1 | 2.8 | 9 | 1 | 2 | 6.7 | 1 |
| 3. | 0.8 | 0.8 | 1 | 1.1 | 1.6 | 1 | 1 | 0.8 | 1 |
| 4. | 0.9 | 0.9 | 1 | 1.2 | 1.6 | 1 | 0.9 | 1 | 1 |
| 5. | 0.9 | 0.9 | 1 | 1 | 1.3 | 1 | 1 | 1 | 1 |
| 6. | 1 | 1.1 | 1 | 2 | 2.8 | 1 | 1 | 1 | n.p. |
| 7. | 1.3 | 9.7 | 1 | 1 | 9 | traces | 1 | n.p. | n.p. |

The rows show the ratios of the following plants: row 1=*Arachis hypogaea*, row 2=*Brassica napus*, row 3=*Glycine max*, row 4=*Linum usitatissimum*, row 5=*Zea mays*, row 6=*Olea europaea* and row 7=*Theobroma cacao*.

Host plants which are advantageous for the process are those which have a high oleic acid content, that means at least 40, 50, 60 or 70% by weight based on the total fatty acid content of the plant, in comparison with linoleic acid and/or linolenic acid in the lipids and/or oils, especially in the triglyceride, such as, for example, *Anarcardium occidentale, Argania spinosa, Bombax malabaricum, Brassica napus, Butyrospermum parkii*, high-oleic safflower (*Carthamus tinctorius*), *Citrullus colocythis, Corylus avellana, Curcurbita foetidissima, Curcurbita pepo, Guizotia abyssinica*, high-oleic sunflower (*Helianthus annus*), *Macadamia intergrifolia, Nigella sativa, Olea europaea, Papaver somniferium, Passiflora edulis, Persea americana, Prunus amygdalis, Prunus armeniaca, Prunus dulcis, Prunus communis, Sesamum indicum, Simarouba glauca, Thea sasumgua*, or *Theobroma cacao*. Further advantageous plants have a higher content of the unsaturated fatty acids oleic acid, linoleic acid and α-linolenic acid in the sn2 position in comparison with the other positions sn1 and sn3. A higher content is understood as meaning ratios of (sn1:sn2:sn3) 1:1.1:1, 1:1.5:1 to 1:3:1. Advantageous plants such as *Actinidia chinensis, Aleurites moluccana, Arnebia griffithii, Brassica alba, Brassica hirta, Brassica nigra, Brassica juncea, Brassica carinata, Camelina sativa, Cannabis sativa, Echium rubrum, Echium vulgare, Humulus lupulus, Juglans regia, Linum usitatissimum, Ocimum* spp., *Perilla frutescens, Portulaca oleracea, Prunus cerasus, Salicornia bigelovii, Salvia hispanica* are also those which have a high α-linolenic acid content in the lipid and/or oil of the plant, that is to say an α-linolenic acid content of at least 10, 15 or 20% by weight, advantageously at least 25, 30, 35, 40, 45 or 50% by weight, based on the total fatty acid content of the plant. Very especially advantageous plants likewise show an advantageous preference for the sn2 position over the positions sn1 and sn3 in the triglyceride of from 1:1.1:1, 1:1.5:1 to 1:3:1 for the arachidonic acid, eicosapentaenoic acid or docosahexaenoic acid produced in the process.

Plants used for the process should advantageously have an erucic acid content of less than 2% by weight based on the total fatty acid content of the plant. Also, the content of saturated fatty acids C16:0 and/or C18:0 should advantageously be less than 19, 18, 17, 16, 15, 14, 13, 12, 11 or 10% by weight, advantageously less than 9, 8, 7, 6 or 5% by weight, based on the total fatty acid content of the plant. Also, longer fatty acids such as C20:0 or C22:1 should advantageously not be present, or only in small amounts, advantageously in amounts of less than 4, 3, 2 or 1% by weight, advantageously less than 0.9, 0.8, 0.7, 0.6, 0.5, 0.4, 0.3, 0.2 or 0.1% by weight based on the total fatty acid content of the plant in the plants used in the process. Typically, C16:1 is not present as fatty acid, or only present in small amounts, in the plants used for the process according to the invention. Small amounts are advantageously understood as meaning fatty acid contents which are less than 4, 3, 2 or 1% by weight, advantageously less than 0.9, 0.8, 0.7, 0.6, 0.5, 0.4, 0.3, 0.2 or 0.1% by weight based on the total fatty acid content of the plant.

For economic reasons, that is to say because of the area under cultivation and the oil yield, plants which are grown on a large scale, such as soybean, oilseed rape, mustard, *Camelina*, linseed, sunflower, oil palm, cotton, sesame, maize, olive, are preferred, preferably oilseed rape, *Camelina*, linseed, sunflower are used frequently as host plant in the process.

Chemically pure polyunsaturated fatty acids or fatty acid compositions can also be synthesized by the processes described above. To this end, the fatty acids or the fatty acid compositions are isolated from the plants, advantageously the seeds of the plants, in the known manner, for example via crushing the seeds, such as grinding, followed by extraction, distillation, crystallization, chromatography or a combination of these methods. These chemically pure fatty acids or fatty acid compositions are advantageous for applications in the food industry sector, the cosmetic sector and especially the pharmacological industry sector.

Plants which are suitable for the process according to the invention are, in principle, all those plants which are capable of synthesizing fatty acids, such as all dicotyledonous or monocotyledonous plants, algae or mosses. Advantageous plants are selected from the group of the plant families Adelotheciaceae, Anacardiaceae, Asteraceae, Apiaceae, Betulaceae, Boraginaceae, Brassicaceae, Bromeliaceae, Caricaceae, Cannabaceae, Compositae, Convolvulaceae, Cruciferae, Cucurbitaceae, Elaeagnaceae, Ericaceae, Euphorbiaceae, Fabaceae, Geraniaceae, Gramineae, Juglandaceae, Lauraceae, Leguminosae, Linaceae, Malvaceae, Moringaceae, Marchantiaceae, Onagraceae, Olacaceae, Oleaceae, Papaveraceae, Piperaceae, Pedaliaceae, Poaceae, Rosaceae or Solanaceae, vorteilhaft Anacardiaceae, Asteraceae, Boraginaceae, Brassicaceae, Cannabaceae, Compositae, Cruciferae, Cucurbitaceae, Elaeagnaceae, Euphorbiaceae, Fabaceae, Geraniaceae, Gramineae, Leguminosae, Linaceae, Malvaceae, Moringaceae, Marchantiaceae, Onagraceae, Olacaceae, Oleaceae, Papaveraceae, Piperaceae, Pedaliaceae, Poaceae or Solaneae, but other plants which are suitable for the process are vegetable plants or ornamentals such as *Tagetes*.

Examples which may be mentioned are the following plants selected from the group consisting of: Anacardiaceae such as the genera *Pistacia, Mangifera, Anacardium*, for example the genus and species *Pistacia vera* [pistachio], *Mangifer indica* [mango] or *Anacardium occidentale* [cashew], Asteraceae, such as the genera *Calendula, Carthamus, Centaurea, Cichorium, Cynara, Helianthus, Lactuca, Locusta, Tagetes, Valeriana*, for example the genus and species *Artemisia sphaerocephala, Calendula officinalis* [common marigold], *Carthamus tinctorius* [safflower], *Centaurea cyanus* [cornflower], *Cichorium intybus* [chicory], *Cynara scolymus* [artichoke], *Helianthus annus* [sunflower], *Lactuca sativa, Lactuca crispa, Lactuca esculenta, Lactuca scariola* L. ssp. *sativa, Lactuca scariola* L. var. *integrata, Lactuca scariola* L. var. *integrifolia, Lactuca sativa* subsp. *romana, Locusta communis, Valeriana locusta* [salad vegetables], *Tagetes lucida, Tagetes erecta* or *Tagetes tenuifolia* [african or french marigold], Apiaceae, such as the genus *Daucus*, for example the genus and species *Daucus carota* [carrot], Betulaceae, such as the genus *Corylus*, for example the genera and species *Corylus avellana* or *Corylus colurna* [hazelnut], Boraginaceae, such as the genus *Adelocaryum, Alkanna, Anchusa, Borago, Brunnera, Cerinthe, Cynoglossum, Echium, Gastrocatyle, Lithospermum, Moltkia, Nonea, Onosma, Onosmodium, Paracaryum, Pectocarya, Symphytum* for example the genus and species *Adelocarym coelestinum, Alkanna orientalis, Anchusa anzurea, Anchusa capensis, Anchusa hybrida, Borago officinalis* [borage], *Brunnera orientalis, Cerinthe minor, Cynoglossum amabile, Cynoglossum lanceolatum, Echium rubrum, Echium vulgare, Gastrocatyle hispida, Lithospermum arvense, Lithosperumum purpureocaeruleum, Moltkia aurea, Moltkia coerules, Nonea macrosperma, Onosma sericeum, Onosmodium molle, Onosmodium occidentale, Paracaryum caelestinum, Pectocarya platycarpa, Symphytum officinale*, Brassicaceae, such as the genera *Brassica, Camelina, Melanosinapis, Sinapis, Arabadopsis*, for example the genera and species *Brassica alba, Brassica carinata, Brassica hirta, Brassica napus, Brassica rapa* ssp. [oilseed rape], *Sinapis arvensis Brassica juncea, Brassica juncea* var. *juncea, Brassica juncea* var. *crispifolia, Brassica juncea* var. *foliosa, Brassica nigra, Brassica sinapioides, Camelina sativa, Melanosinapis communis* [mustard], *Brassica oleracea* [fodder beet] or *Arabidopsis thaliana*, Bromeliaceae, such as the genera *Anana, Bromelia* (pineapple), for example the genera and species *Anana comosus, Ananas ananas* or *Bromelia comosa* [pineapple], Caricaceae, such as the genus *Carica*, such as the genus and species *Carica papaya* [pawpaw], Cannabaceae, such as the genus *Cannabis*, such as the genus and species *Cannabis sativa* [hemp], Convolvulaceae, such as the genera *Ipomea, Convolvulus*, for example the genera and species *Ipomoea batatas, Ipomoea pandurata, Convolvulus batatas, Convolvulus tiliaceus, Ipomoea fastigiata, Ipomoea tiliacea, Ipomoea triloba* or *Convolvulus panduratus* [sweet potato, batate], Chenopodiaceae, such as the genus *Beta*, such as the genera and species *Beta vulgaris, Beta vulgaris* var. *altissima, Beta vulgaris* var. *vulgaris, Beta maritima, Beta vulgaris* var. *perennis, Beta vulgaris* var. *conditiva* or *Beta vulgaris* var. *esculenta* [sugarbeet], Crypthecodiniaceae, such as the genus *Crypthecodinium*, for example the genus and species *Crypthecodinium cohnii*, Cucurbitaceae, such as the genus *Cucurbita*, for example the genera and species *Cucurbita maxima, Cucurbita mixta, Cucurbita pepo* or *Cucurbita moschata* [pumpkin/squash], Elaeagnaceae, such as the genus *Elaeagnus*, for example the genus and species *Olea europaea* [olive], Ericaceae, such as the genus *Kalmia*, for example the genera and species *Kalmia latifolia, Kalmia angustifolia, Kalmia microphylla, Kalmia polifolia, Kalmia occidentalis, Cistus chamaerhodendros* or *Kalmia lucida* [mountain laurel], Euphorbiaceae, such as the genera *Manihot, Janipha, Jatropha, Ricinus*, for example the genera and species *Manihot utilissima, Janipha manihot, Jatropha manihot, Manihot aipil, Manihot dulcis, Manihot manihot, Manihot melanobasis, Manihot esculenta* [cassava] or *Ricinus communis* [castor-oil plant], Fabaceae, such as the genera *Pisum, Albizia, Cathormion, Feuillea, Inga, Pithecolobium, Acacia, Mimosa, Medicajo, Glycine, Dolichos, Phaseolus*, soybean, for example the genera and species *Pisum sativum, Pisum arvense, Pisum humile* [pea], *Albizia berteriana, Albizia julibrissin, Albizia lebbeck, Acacia berteriana, Acacia littoralis, Albizia berteriana, Albizzia berteriana, Cathormion berteriana, Feuillea berteriana, Inga fragrans, Pithecellobium berterianum, Pithecellobium fragrans, Pithecolobium berterianum, Pseudalbizzia berteriana, Acacia julibrissin, Acacia nemu, Albizia nemu, Feuilleea julibrissin, Mimosa julibrissin, Mimosa speciosa, Sericanrda julibrissin, Acacia lebbeck, Acacia macrophylla, Albizia lebbeck, Feuilleea lebbeck, Mimosa lebbeck, Mimosa speciosa* [silk tree], *Medicago sativa, Medicago falcata, Medicago varia* [alfalfa] *Glycine max, Dolichos soja, Glycine gracilis, Glycine hispida, Phaseolus max, Soja hispida* or *Soja max* [soybean], Geraniaceae, such as the genera *Pelargonium, Cocos, Oleum*, for example the genera and species *Cocos nucifera, Pelargonium grossularioides* or *Oleum cocois* [coconut], Gramineae, such as the genus *Saccharum*, for example the genus and species *Saccharum officinarum*, Juglandaceae, such as the genera *Juglans, Wallia*, for example the genera and species *Juglans regia, Juglans ailanthifolia, Juglans sieboldiana, Juglans cinerea, Wallia cinerea, Juglans bixbyi, Juglans californica, Juglans hindsii, Juglans intermedia, Juglans jamaicensis, Juglans major, Juglans microcarpa, Juglans nigra* or *Wallia nigra* [walnut], Lauraceae, such as the genera *Persea, Laurus*, for example the genera and species *Laurus nobilis* [bay], *Persea americana, Persea gratissima* or *Persea persea* [avocado], Leguminosae, such as the genus *Arachis*, for example the genus and species *Arachis hypogaea* [peanut], Linaceae, such as the genera *Adenolinum*, for example the genera and species *Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense* or *Linum trigynum* [linseed], Lythrarieae, such as the genus *Punica*, for example the genus and species *Punica granatum* [pomegranate], Malvaceae, such as the genus *Gossypium*, for example the genera and species *Gossypium hirsutum, Gossypium arboreum, Gossypium barbadense, Gossypium herbaceum* or *Gossypium thurberi* [cotton], Marchantiaceae, such as the genus *Marchantia*, for example the genera and species *Marchantia berteroana, Marchantia foliacea, Marchantia macropora*, Musaceae, such as the genus *Musa*, for example the genera and species *Musa nana, Musa acuminata, Musa paradisiaca, Musa* spp. [banana], Onagraceae, such as the genera *Camissonia, Oenothera*, for example the genera and species *Oenothera biennis* or *Camissonia brevipes* [evening primrose], Palmae, such as the genus *Elaeis*, for example the genus and species *Elaeis guineensis* [oil palm], Papaveraceae, such as, for example, the genus *Papaver*, for example the genera and species *Papaver orientale*, *Papaver rhoeas*, *Papaver dubium* [poppy], Pedaliaceae, such as the genus *Sesamum*, for example the genus and species *Sesamum indicum* [sesame], Piperaceae, such as the genera *Piper, Artanthe, Peperomia, Steffensia*, for example the genera and species *Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata* [cayenne pepper], Poaceae, such as the genera *Hordeum, Secale, Avena, Sorghum, Andropogon, Holcus, Panicum, Oryza, Zea* (maize), *Triticum*, for example the genera and species *Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum* [barley], *Secale cereale* [rye], *Avena sativa, Avena fatua, Avena byzantina, Avena fatua* var. *sativa, Avena hybrida* [oats], *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cemuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum, Panicum militaceum* [millet], *Oryza sativa, Oryza latifolia* [rice], *Zea mays* [maize] *Triticum aestivum, Triticum durum, Triticum turgidum, Triticum hybemum, Triticum macha, Triticum sativum* or *Triticum vulgare* [wheat], Porphyridiaceae, such as the genera *Chroothece, Flintiella, Petrovanella, Porphyridium, Rhodella, Rhodosorus, Vanhoeffenia*, for example the genus and species *Porphyridium cruentum*, Proteaceae, such as the genus *Macadamia*, for example the genus and species *Macadamia intergrifolia* [macadamia], Rosaceae, such as the genus *Prunus*, for example the genus and species *Prunus armeniaca, Prunus amygdalus, Prunus avilum*, Rubiaceae, such as the genus *Coffea*, for example the genera and species *Coffea* spp., *Coffea arabica, Coffea canephora* or *Coffea liberica* [coffee], Scrophulariaceae, such as the genus *Scrophularia, Verbascum*, for example the genera and species *Scrophularia marilandica, Verbascum blattaria, Verbascum chaixii, Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum* or *Verbascum thapsus* [mullein], Solanaceae, such as the genera *Capsicum, Nicotiana, Solanum, Lycopersicon*, for example the genera and species *Capsicum annuum, Capsicum annuum* var. *glabriusculum, Capsicum frutescens* [pepper], *Capsicum annuum* [paprika], *Nicotiana tabacum, Nicotiana alata, Nicotiana attenuata, Nicotiana glauca, Nicotiana langsdorffii, Nicotiana obtusifolia, Nicotiana quadrivalvis, Nicotiana repanda, Nicotiana rustica, Nicotiana sylvestris* [tobacco], *Solanum tuberosum* [potato], *Solanum melongena* [eggplant] *Lycopersicon esculentum, Lycopersicon lycopersicum, Lycopersicon pyriforme, Solanum integrifolium* or *Solanum lycopersicum* [tomato], Sterculiaceae, such as the genus *Theobroma*, for example the genus and species *Theobroma cacao* [cacao] or Theaceae, such as the genus *Camellia*, for example the genus and species *Camellia sinensis* [tea]. Further plants which may be mentioned are the genus and species *Argania spinosa, Arnebia griffithii, Adansonia digitata, Orbignya martiana, Carum carvi, Bertholletia excelsa, Aleurites moluccana, Hydnocarpus kursii, Salvia hispanica, Vitis vinifera, Corvlus avellana, Humulus lupus, Hyptis spicigera* and *Shorea stenoptera*.

Plants which are advantageously used in the process according to the invention are transgenic plants such as dicotyledonous or monocotyledonous plants. Plants which are especially advantageously used in the process according to the invention are transgenic plants which belong to the oil-producing plants, that is to say which are used for the production of oils, such as, preferably, oil fruit crops which comprise large amounts of lipid compounds, such as peanut, oilseed rape, canola, sunflower, safflower (*Carthamus tinctoria*), poppy, mustard, hemp, castor-oil plant, olive, sesame, *Calendula, Punica*, evening primrose, mullein, thistle, wild roses, hazelnut, almond, macadamia, avocado, bay, pumpkin/squash, linseed, soybean, pistachios, borage, trees (oil palm, coconut, walnut) or crops such as maize, wheat, rye, oats, triticale, rice, barley, cotton, cassava, pepper, *Tagetes*, Solanaceae plants such as potato, tobacco, eggplant and tomato, *Vicia* species, pea, alfalfa or bushy plants (coffee, cacao, tea), *Salix* species, and perrenial grasses and fodder crops.

Preferred plants according to the invention are oilseed and oil crop plants such as peanut, oilseed rape, canola, sunflower, safflower, poppy, Indian mustard, mustard, hemp, castor-oil plant, olive, *Calendula, Punica*, evening primrose, pumpkin/squash, linseed, soybean, borage, trees (oil palm, coconut). Especially preferred are plants which are high in C18:2- and/or C18:3-fatty acids, such as sunflower, safflower, tobacco, mullein, sesame, cotton, pumpkin/squash, poppy, evening primrose, walnut, linseed, hemp, thistle or safflower. Very especially preferred are plants such as safflower, sunflower, poppy, evening primrose, walnut, linseed, Indian mustard, *Camelina* or hemp.

It is advantageous for the above-described processes according to the invention to additionally introduce, into the plant, further nucleic acids which encode enzymes of the fatty acid or lipid metabolism, in addition to the nucleic acids introduced in steps (a) to (e) or (a) to (c) of the process, and the optionally introduced nucleic acid sequences which encode the ω3-desaturases and/or the Δ12-desaturases.

In principle, all genes of the fatty acid or lipid metabolism can be used in the process for the production of polyunsaturated fatty acids, advantageously in combination with the Δ5-elongase(s), Δ6-elongase(s) and/or ω3-desaturases [for the purposes of the present invention, the plural is understood as encompassing the singular and vice versa]. Genes of the fatty acid or lipid metabolism selected from the group consisting of acyl-CoA dehydrogenase(s), acyl-ACP [=acyl carrier protein] desaturase(s), acyl-ACP thioesterase(s), fatty acid acyl transferase(s), acyl-CoA:lysophospholipid acyltransferases, fatty acid synthase(s), fatty acid hydroxylase(s), acetyl-coenzyme A carboxylase(s), acyl-coenzyme A oxidase(s), fatty acid desaturase(s), fatty acid acetylenases, lipoxygenases, triacylglycerol lipases, allenoxide synthases, hydroperoxide lyases or fatty acid elongase(s) are advantageously used in combination with the Δ5-elongase, Δ6-elongase and/or ω3-desaturase. Genes selected from the group of the Δ4-desaturases, Δ5-desaturases, Δ6-desaturases, Δ8-desaturases, Δ9-desaturases, Δ12-desaturases, Δ6-elongases or Δ9-elongases are especially preferably used in combination with the above genes for the Δ5-elongase, Δ6-elongase and/or ω3-desaturase, it being possible to use individual genes or a plurality of genes in combination. The abovementioned genes are advantageously used in combination with the Δ6-elongase, Δ5-elongase, Δ5-desaturase, Δ6-desaturase and/or Δ12-desaturase used in accordance with the invention.

Genes selected from the group of the Δ8-desaturases, Δ9-desaturases, Δ5-elongase or Δ9-elongases are especially preferably used in combination with the abovementioned genes.

Owing to the enzymatic activity of the nucleic acids used in the process according to the invention which encode polypeptides with Δ6-elongase, Δ6-desaturase, Δ5-desaturase and/or Δ12-desaturase activity, advantageously in combination with nucleic acid sequences which encode polypeptides of the fatty acid or lipid metabolism, such as polypeptides with Δ8-desaturase, or Δ5- or Δ9-elongase activity, a wide range of polyunsaturated fatty acids can be produced in the process according to the invention. Depending on the choice of plants used for the process according to the invention, mixtures of the various polyunsaturated fatty acids or individual polyunsaturated fatty acids, such as EPA or ARA, can be produced in free or bound form. Depending on the prevailing fatty acid composition in the starting plant (C18:2- or C18:3-fatty acids), fatty acids which are derived from C18:2-fatty acids, such as GLA, DGLA or ARA, or fatty acids which are derived from C18:3-fatty acids, such as SDA, ETA or EPA, are thus obtained. If only linoleic acid (=LA, $C18:2^{\Delta9,12}$) is present as unsaturated fatty acid in the plant used for the process, the process can only afford GLA, DGLA and ARA as products, all of which can be present as free fatty acids or in bound form. If only α-linolenic acid (=ALA, $C18:3^{\Delta9,12,15}$) is present as unsaturated fatty acid in the plant used for the process, as is the case, for example, in linseed, the process can only afford SDA, ETA or EPA as products, all of which can be present as free fatty acids or in bound form, as described above.

Owing to the activity of Δ6-desaturase and Δ6-elongase, products formed are, for example, GLA and DGLA, or SDA and ETA, respectively, depending on the starting plant and the unsaturated fatty acid present therein. DGLA or ETA or mixtures of these are preferentially formed. If Δ5-desaturase is additionally introduced into the plant, ARA and/or EPA are also formed. If, moreover, genes which encode a Δ5-elongase and/or Δ4-desaturase activity are additionally introduced, the fatty acids DPA and/or DHA can be produced in the process according to the invention. Advantageously, only ARA, EPA and/or DHA or mixtures of these are synthesized, depending on the fatty acid present in the plant, which acts as starting substance for the synthesis. Since biosynthetic cascades are involved, the end products in question are not present in pure form in the organisms. Small amounts of the precursor compounds are always additionally present in the end product. These small amounts amount to less than 20% by weight, advantageously less than 15% by weight, especially advantageously less than 10% by weight, most advantageously less than 5, 4, 3, 2 or 1% by weight, based on the end products DGLA, ETA or their mixtures, or ARA, EPA or their mixtures, or ARA, EPA, DHA or their mixtures.

In addition to the production directly in the plant, of the starting fatty acids for the enzymes used in the process of the invention, the fatty acids can also be fed externally. The production in the plant is preferred for reasons of economy. Substrates which are preferred for the production of ARA are linoleic acid ($C18:2^{\Delta9,12}$), γ-linolenic acid ($C18:3^{\Delta6,9,12}$) and dihomo-γ-linolenic acid ($20:3^{\Delta8,11,14}$). Substrates which are preferred for the production of EPA are linolenic acid ($C18:3^{\Delta9,12,15}$), stearidonic acid ($C18:4^{\Delta6,9,12,15}$) and eicosatetraenoic acid ($C20:4^{\Delta8,11,14,17}$). Substrates which are preferred for the production of DHA are linolenic acid ($C18:3^{\Delta9,12,15}$), stearidonic acid ($C18:4^{\Delta6,9,12,15}$), eicosatetraenoic acid ($C20:4^{\Delta8,11,14,17}$), EPA and DPA.

In comparison with the human elongases or elongases from non-human animals, such as those from *Oncorhynchus*, *Xenopus* or *Ciona*, the Δ5-elongases according to the invention have the advantageous characteristic that they do not elongate $C_{22}$-fatty acids to the corresponding $C_{24}$-fatty acids. Furthermore, they advantageously do not convert fatty acids with a double bond in the Δ6-position, as is the case with the human elongases or the elongases from non-human animals. Especially advantageously Δ5-elongases preferentially only convert unsaturated $C_{20}$-fatty acids. These advantageous Δ5-elongases contain some putative transmembrane helices (5-7). Advantageously, only $C_{20}$-fatty acids with one double bond in the Δ5-position are converted, with ω3-$C_{20}$-fatty acids being preferred (EPA). Moreover, in a preferred embodiment of the invention, they have the characteristic that, besides the Δ5-elongase activity, they advantageously have no, or only relatively low, Δ6-elongase activity. In contrast, the human elongases or non-human animal elongases have approximately the same activity towards fatty acids with a Δ6- or Δ5-double bond. These advantageous elongases are referred to what are known as monofunctional elongases. In contrast, the human elongases or the non-human animal elongases are referred to as multifunctional elongases, which, besides the abovementioned substrates, also convert monounsaturated $C_{16}$- and $C_{18}$-fatty acids, for example with Δ9- or Δ11-double bonds. In a yeast feeding text, in which EPA was added to the yeast as the substrate, the monofunctional elongases convert at least 15% by weight of the added EPA into docosapentaenoic acid (DPA, $C22:5^{\Delta7,10,13,16,19}$), advantageously at least 20% by weight, especially advantageously at least 25% by weight. If γ-linolenic acid (=GLA, $C18:3^{\Delta6,9,12}$) is added as the substrate, this acid is advantageously not elongated at all. Likewise, $C18:3^{\Delta6,9,12}$ is not elongated. In another advantageous embodiment, less than 60% by weight of the added GLA is converted into dihomo-γ-linolenic acid (=$C20:3^{\Delta8,11,14}$), advantageously less than 55% by weight, preferably less than 50% by weight, especially advantageously less than 45% by weight, very especially advantageously less than 40% by weight. In a further, very preferred embodiment of the Δ5-elongase activity according to the invention, GLA is not converted.

FIGS. 27 and 28 show the measured substrate specificities of the various elongases. FIG. 27 shows the specificities of the multifunctional elongases from *Xenopus laevis* (FIG. 27 A), *Ciona intestinalis* (FIG. 27 B) and *Oncorhynchus mykiss* (FIG. 27 C). All these elongases convert a broad substrate spectrum. In the process according to the invention, this can lead to by-products, which must be converted by further enzymatic activities. This is why these enzymes are less preferred in the process according to the invention. The preferred monofunctional elongases and their substrate specificity are shown in FIG. 28. FIG. 28 A shows the specificity of the *Ostreococcus tauri* Δ5-elongase. This enzyme only converts fatty acids with a double bond in the Δ5-position. Advantageously, only $C_{20}$-fatty acids are converted. A similarly high substrate specificity is shown by the *Thallasiosira pseudonana* Δ5-elongase (FIG. 28. C). Both the *Ostreococcus tauri* Δ6-elongase (FIG. 28 B) as that of *Thallasiosira pseudonana* (FIG. 28 D) advantageously only convert fatty acids with a double bond in the Δ6-position. Advantageously, only $C^{18}$-fatty acids are converted. The Δ5-elongases from *Arabidopsis thaliana* and *Euglena gracilis* are also distinguished by their specificities.

Likewise, advantageous Δ6-elongases according to the invention are distinguished by a high specificity, that is to say that $C_{18}$-fatty acids are preferentially elongated. They advantageously convert fatty acids with a double bond in the Δ6-position. Especially advantageous Δ6-elongases advantageously convert $C_{18}$-fatty acids with three or four double bonds in the molecule, which fatty acids must comprise a double bond in the Δ6-position. Moreover, in a preferred embodiment of the invention, they have the characteristic that, besides the Δ6-elongase activity, they advantageously have no, or only relatively low, Δ5-elongase activity. In contrast, the human elongases or non-human animal elongases have approximately the same activity towards fatty acids with a Δ6- or Δ5-double bond. These advantageous elongases are referred to as what are known as monofunctional elongases. In contrast, the human elongases or the non-human animal elongases are referred to as multifunctional elongases, which, besides the abovementioned substrates, also convert monounsaturated $C_{16}$- and $C_{18}$-fatty acids, for example with Δ9- or Δ11-double bonds. In a yeast feeding text, in which EPA has been added to the yeasts as the substrate, the monofunctional elongases convert at least 10% by weight of the added α-linolenic acid (=ALA, $C18:3^{\Delta 9,12,15}$) or at least 40% by weight of added γ-linolenic acid (=GLA, $C18:3^{\Delta 6,9,12}$), advantageously at least 20% by weight and 50% by weight, respectively, especially advantageously at least 25% by weight and 60% by weight, respectively. It is especially advantageous that $C18:4^{\Delta 6,9,12,15}$ (stearidonic acid) is also elongated. Here, SDA is converted to at least 40% by weight, advantageously to at least 50% by weight, especially advantageously to at least 60% by weight, very especially advantageously to at least 70% by weight. Especially advantageous Δ6-elongases show no, or only very low activity (less than 0.1% by weight conversion rate) toward the following substrates: $C18:1^{\Delta 6}$, $C18:1^{\Delta 9}$, $C18:1^{\Delta 11}$, $C20:2^{\Delta 11,14}$, $C20:3^{\Delta 11,14,17}$, $C20:3^{\Delta 8,11,14}$, $C20:4^{\Delta 5,8,11,14}$, $C20:5^{\Delta 5,8,11,14,17}$ or $C22:4^{\Delta 7,10,13,16}$.

FIGS. 29 and 30 and Table 21 show the measured substrate specificities of the various elongases.

In comparison with the known ω3-desaturase, the ω3-desaturase used in the process according to the invention has the advantageous characteristic that it is capable of desaturating a broad spectrum of ω6-fatty acids, with $C_{20}$- and $C_{22}$-fatty acids such as $C_{20:2}$-, $C_{20:3}$-, $C_{20:4}$-, $C_{22:4}$- or $C_{22:5}$-fatty acids being preferentially desaturated. However, the shorter $C_{18}$-fatty acids such as $C_{18:2}$- or $C_{18:3}$-fatty acids are also advantageously desaturated. Owing to these characteristics of ω3-desaturase, it is advantageously possible to shift the fatty acid spectrum within an organism, advantageously within a plant or a fungus, from the ω6-fatty acids towards the ω3-fatty acids. The ω3-desaturase according to the invention preferentially desaturates $C_{20}$-fatty acids. Within the organism, these fatty acids are converted to at least 10%, 15%, 20%, 25% or 30% from the existing fatty acid pool to give the corresponding ω3-fatty acids. In comparison with the $C_{18}$-fatty acids, the activity of ω3-desaturase is lower by a factor of 10, that is to say only approximately 1.5 to 3% of the fatty acids present in the fatty acid pool are converted into the corresponding ω3-fatty acids. Preferred substrates of the ω3-desaturase according to the invention are the ω6-fatty acids bound in phospholipids. With reference to the desaturation of dihomo-γ-linolenic acid [$C_{20:4}^{\Delta 8,11,14}$], FIG. 19 shows clearly that ω3-desaturase advantageously does not differentiate between fatty acids bound at the sn1 or sn2 position when desaturation takes place. Both fatty acids bound at the sn1 position and fatty acids bound in the sn2 position in the phospholipids are desaturated. Another advantage is that ω3-desaturase converts a broad range of phospholipids such as phosphatidylcholine (=PC), phosphatidylinositol (=PIS) or phosphatidylethanolamine (=PE). Finally, desaturation products are also found in the neutral lipids (=NL), i.e. in the triglycerides.

In comparison with the known Δ4-desaturases, Δ5-desaturases and Δ6-desaturases, the advantage of the Δ4-desaturases, Δ5-desaturases and Δ6-desaturases used in the process according to the invention is that they can convert fatty acids which are bound to phospholipids or CoA-fatty acid esters, advantageously CoA-fatty acid esters.

The Δ12-desaturases used in the process according to the invention advantageously convert oleic acid ($C18:1^{\Delta 9}$) into linoleic acid ($C18:2^{\Delta 9,12}$) or $C18:2^{\Delta 6,9}$ into $C18:3^{\Delta 6,9,12}$ (=GLA). The Δ12-desaturases used advantageously convert fatty acids which are bound to phospholipids or CoA-fatty acid esters, advantageously those which are bound to CoA-fatty acid esters.

Owing to the enzymatic activity of the nucleic acids used in the process according to the invention which encode polypeptides with Δ5-elongase, Δ6-elongase and/or ω3-desaturase activity, advantageously in combination with nucleic acid sequences which encode polypeptides of the fatty acid or lipid metabolism, such as additionally polypeptides with Δ4-, Δ5-, Δ12-desaturase or Δ5-, Δ6- or Δ9-elongase activity, a very wide range of polyunsaturated fatty acids can be produced in the process according to the invention. Depending on the choice of the advantageous plants used for the process according to the invention, mixtures of the various polyunsaturated fatty acids or individual polyunsaturated fatty acids such as EPA, ARA or DHA, can be produced in free or bound form. Depending on the prevailing fatty acid composition in the starting plant (C18:2- or C18:3-fatty acids), fatty acids which are derived from C18:2-fatty acids, such as GLA, DGLA or ARA, or which are derived from C18:3-fatty acids, such as SDA, ETA, EPA or DHA, are thus obtained. If only linoleic acid (=LA, $C18:2^{\Delta 9,12}$) is present as unsaturated fatty acid in the plant used for the process, the process can only afford GLA, DGLA and ARA as products, all of which can be present as free fatty acids or in bound form. By expressing the additional ω3-desaturase in plants, the fatty acid spectrum can be shifted towards α-linolenic acid, DPA and DHA. However, this shift in the fatty acid spectrum is only relatively limited. More advantageous is such a shift in plants which, as described hereinbelow, already have a high α-linolenic acid content. If only α-linolenic acid (=ALA, $C18:3^{\Delta 9,12,15}$) is present as unsaturated fatty acid in the plant, as is the case, for example, in linseed, the process can only afford SDA, ETA, EPA and/or DHA, which, as described above, may be present as free fatty acids or in bound form. Owing to the modification of the activity of the enzyme Δ5-elongase which plays a role in the synthesis, advantageously in combination with Δ4-, Δ5-, Δ12-desaturase and/or Δ6-elongase, or Δ4-, Δ12-desaturase, and/or Δ9-elongase, it is possible to produce, in a targeted fashion, only individual products in the abovementioned plants. Owing to the activity of Δ6-desaturase and Δ6-elongase, for example, GLA and DGLA, or SDA and ETA, are formed, depending on the starting plant and unsaturated fatty acids. DGLA or ETA or mixtures of these are preferentially formed. If Δ5-desaturase, Δ5-elongase and Δ4-desaturase are additionally introduced into the organisms, advantageously into the plant, ARA, EPA and/or DHA are additionally formed. This also applies to organisms into which Δ8-desaturase and Δ9-elongase have previously been introduced. Advantageously, only ARA, EPA or DHA or their mixtures are synthesized, depending on the fatty acid present in the plant, which acts as starting substance for the synthesis. Since biosynthetic cascades are involved, the end products in question are not present in pure form in the organisms. Small amounts of the precursor compounds are always additionally present in the end product. These small amounts amount to less than 20% by weight, advantageously less than 15% by weight, especially advantageously less than 10% by weight, very especially advantageously less than 5, 4, 3, 2, or 1% by weight, based on the end product DGLA, ETA or their mixtures, or ARA, EPA, DHA or their mixtures, advantageously EPA or DHA or their mixtures.

The nucleic acid with the SEQ ID NO: 53, which is derived from trout and which can be used in the process according to the invention, encodes a protein with high specificity for the two $C18:4^{\Delta6,9,12,15}$- and $C20:5^{\Delta5,8,11,14,17}$-fatty acids, which are precursors for the synthesis of DHA (precursors and synthesis of DHA, see FIG. 1). However, other fatty acids too are elongated by the enzyme. The protein encoded by SEQ ID NO: 53 thus has specificity for Δ6- and Δ5-fatty acids with additionally one ω3-double bond (FIG. 2). Δ5-elongase has a keto-acyl-CoA synthase activity which advantageously elongates fatty acid residues of acyl-CoA esters by 2 carbon atoms.

The synthesis of DHA in yeast (*Saccharomyces cerevisiae*) was detected by the gene product of the abovementioned fish Δ5-elongase gene and further Δ5-elongases, the Δ5-desaturase from *Phaeodactylum* and the Δ4-desaturase from *Euglena* (FIG. 3).

In addition to the production directly in the transgenic organism, advantageously in the transgenic plant, of the starting fatty acids for the Δ5-elongases, Δ6-elongases, Δ9-elongases, Δ4-desaturases, Δ5-desaturases, Δ6-desaturases, Δ12-desaturases and/or ω3-desaturases advantageously used in the process according to the invention, the fatty acids can also be shed externally. The production in the organism is preferred for reasons of economy. Preferred substrates of ω3-desaturase are linoleic acid ($C18:2^{\Delta9,12}$), γ-linolenic acid ($C18:3^{\Delta6,9,12}$), eicosadienoic acid ($C20:2^{\Delta11,14}$), dihomo-γ-linolenic acid ($C20:3^{\Delta8,11,14}$), arachidonic acid ($C20:4^{\Delta5,8,11,14}$), docosatetraenoic acid ($C22:4^{\Delta7,10,13,16}$) and docosapentaenoic acid ($C22:5^{\Delta4,7,10,13,15}$).

To increase the yield in the above-described process for the production of oils and/or triglycerides with an advantageously elevated content of polyunsaturated fatty acids, it is advantageous to increase the amount of starting product for the synthesis of fatty acids; this can be achieved for example by introducing, into the organism, a nucleic acid which encodes a polypeptide with Δ12-desaturase activity. This is particularly advantageous in oil-producing organisms such as those from the family of the Brassicaceae, such as the genus *Brassica*, for example oilseed rape; the family of the Elaeagnaceae, such as the genus *Elaeagnus*, for example the genus and species *Olea europaea*, or the family Fabaceae, such as the genus *Glycine*, for example the genus and species *Glycine max*, which are high in oleic acid. Since these organisms are only low in linoleic acid (Mikoklajczak et al., Journal of the American Oil Chemical Society, 38, 1961, 678-681), the use of the abovementioned Δ12-desaturases for producing the starting material linoleic acid is advantageous.

Nucleic acids used in the process according to the invention are advantageously derived from plants such as algae, for example algae of the family of the Prasinophyceae such as the genera *Heteromastix, Mammella, Mantoniella, Micromonas, Nephroselmis, Ostreococcus, Prasinocladus, Prasinococcus, Pseudoscourfielda, Pycnococcus, Pyramimonas, Scherffelia* or *Tetraselmis* such as the genera and species *Heteromastix longifillis, Mamiella gilva, Mantoniella squamata, Micromonas pusilla, Nephroselmis olivacea, Nephroselmis pyriformis, Nephroselmis rotunda, Ostreococcus tauri, Ostreococcus* sp. *Prasinocladus ascus, Prasinocladus lubricus, Pycnococcus provasolii, Pyramimonas amylifera, Pyramimonas disomata, Pyramimonas obovata, Pyramimonas orientalis, Pyramimonas parkeae, Pyramimonas spinifera, Pyramimonas* sp., *Tetraselmis apiculata, Tetraselmis carteriaformis, Tetraselmis chui, Tetraselmis convolutae, Tetraselmis desikacharyi, Tetraselmis gracilis, Tetraselmis hazeni, Tetraselmis impellucida, Tetraselmis inconspicua, Tetraselmis levis, Tetraselmis maculata, Tetraselmis marina, Tetraselmis striata, Tetraselmis subcordiformis, Tetraselmis suecica, Tetraselmis tetrabrachia, Tetraselmis tetrathele, Tetraselmis verrucosa, Tetraselmis verrucosa* fo. *rubens* or *Tetraselmis* sp. or from algae of the family Euglenaceae such as from the genera *Ascoglena, Astasia, Colacium, Cyclidiopsis, Euglena, Euglenopsis, Hyalophacus, Khawkinea, Lepocinclis, Phacus, Strombomonas* or *Trachelomonas* such as the genera and species *Euglena acus, Euglena geniculata, Euglena gracilis, Euglena mixocylindrica, Euglena rostrifera Euglena viridis, Colacium stentorium, Trachelomonas cylindrica* or *Trachelomonas volvocina*. The nucleic acid sequences used in the process can also advantageously be derived from algae, such as the alga *Porphyridium cruentum, Isochrysis galbana* or *Chlorella minutissima, Chlorella vulgaris, Thraustochytrium aureum* or *Nannochloropsis oculata*. The nucleic acids used are advantageously derived from algae of the genera *Euglena, Mantoniella* or *Ostreococcus*.

Further advantageous plants as sources for the nucleic acid sequences used in the process according to the invention are algae such as *Isochrysis* or *Crypthecodinium*, algae/diatoms such as *Thalassiosira* or *Phaeodactylum*, mosses such as *Physcomitrella* or *Ceratodon*, or higher plants such as the Primulaceae such as *Aleuritia, Calendula stellata, Osteospermum spinescens* or *Osteospermum hyoseroides*, microorganisms such as fungi, such as *Aspergillus, Thraustochytrium, Phytophthora, Entomophthora, Mucor* or *Mortierella*, bacteria such as *Shewanella*, yeasts or animals such as nematodes such as *Caenorhabditis*, insects, frogs, sea cucumber or fish. The isolated nucleic acid sequences according to the invention are advantageously derived from an animal of the order of the vertebrates. Preferably, the nucleic acid sequences are derived from the classes of the Vertebrata; Euteleostomi, Actinopterygii; Neopterygii; Teleostei; Euteleostei, Protacanthopterygii, Salmoniformes; Salmonidae or *Oncorhynchus* or Vertebrata, Amphibia, Anura, Pipidae, *Xenopus* or Evertebrata such as Protochordata, Tunicata, Holothuroidea, Cionidae such as *Amaroucium constellatum, Botryllus schlosseri, Ciona intestinalis, Molgula citrina, Molgula manhattensis, Perophora viridis* or *Styela partita*. The nucleic acids are especially advantageously derived from fungi, animals, or from plants such as algae or mosses, preferably from the order of the Salmoniformes, such as the family of the Salmonidae, such as the genus *Salmo*, for example from the genera and species *Oncorhynchus mykiss, Trutta trutta* or *Salmo trutta fario*, from algae, such as the genera *Mantoniella* or *Ostreococcus*, or from the diatoms such as the genera *Thalassiosira* or *Phaeodactylum* or from algae such as *Crypthecodinium*.

Advantageous nucleic acid used in the process according to the invention can also be derived from microorganisms such as fungi such as the genus *Mortierella, Phytium*, for example the genus and species *Mortierella alpiina, Mor-* tierella elongata, *Phytium irregulare*, *Phytium ultimum* or bacteria such as the genus *Shewanella*, for example the genus and species *Shewanella hanedai*.

The process according to the invention advantageously employs the abovementioned nucleic acid sequences or their derivatives or homologs which encode polypeptides which retain the enzymatic activity of the proteins encoded by nucleic acid sequences. These sequences, individually or in combination with the nucleic acid sequences which encode Δ12-desaturase, Δ4-desaturase, Δ5-desaturase, Δ6-desaturase, Δ5-elongase, Δ6-elongase and/or ω3-desaturase, are cloned into expression constructs and used for the introduction into, and expression in, organisms. Owing to their construction, these expression constructs make possible an advantageous optimal synthesis of the polyunsaturated fatty acids produced in the process according to the invention.

In a preferred embodiment, the process furthermore comprises the step of obtaining a transgenic plant which comprises the nucleic acid sequences used in the process, where the plant is transformed with a nucleic acid sequence according to the invention which encodes the Δ12-desaturase, Δ4-desaturase, Δ5-desaturase, Δ6-desaturase, Δ5-elongase, Δ6-elongase and/or ω3-desaturase, a gene construct or a vector as described below, alone or in combination with further nucleic acid sequences which encode proteins of the fatty acid or lipid metabolism. In a further preferred embodiment, this process furthermore comprises the step of obtaining the oils, lipids or free fatty acids from the seed of the plant, such as, for example, the seed of an oil crop, such as, for example, peanut, oilseed rap, canola, linseed, hemp, peanut, soybean, safflower, hemp, sunflowers or borage.

In the case of plant cells, plant tissue or plant organs, "growing" is understood as meaning, for example, the cultivation on or in a nutrient medium, or of the intact plant on or in a substrate, for example in a hydroponic culture, potting compost or on arable land.

The invention furthermore relates to gene constructs which comprise the nucleic acid sequences according to the invention which encode a Δ5-desaturase, Δ6-desaturase, Δ5-elongase or Δ6-elongase, the nucleic acid being linked functionally with one or more regulatory signals. In addition, the gene construct may comprise further biosynthesis genes of the fatty acid or lipid metabolism selected from the group consisting of acyl-CoA dehydrogenase(s), acyl-ACP [=acyl carrier protein] desaturase(s), acyl-ACP thioesterase(s), fatty acid acyl transferase(s), acyl-CoA:lysophospholipid acyltransferases, fatty acid synthase(s), fatty acid hydroxylase(s), acetyl-coenzyme A carboxylase(s), acyl-coenzyme A oxidase(s), fatty acid desaturase(s), fatty acid acetylenases, lipoxygenases, triacylglycerol lipases, allenoxide synthases, hydroperoxide lyases or fatty acid elongase(s). Biosynthesis genes of the fatty acid or lipid metabolism selected from the group Δ8-desaturase, Δ9-desaturase, Δ9-elongase or ω3-desaturase are advantageously additionally present.

The nucleic acid sequences used in the process which encode proteins with Δ5-desaturase, Δ6-desaturase, Δ12-desaturase, Δ5-elongase or Δ6-elongase activity are advantageously introduced into the plant alone or, preferably, in combination with an expression cassette (=nucleic acid construct) which makes possible the expression of the nucleic acids in the plant. The nucleic acid construct can comprise more than one nucleic acid sequence with an enzymatic activity, for example, of a Δ12-desaturase, Δ5-desaturase, Δ6-desaturase, Δ5-elongase and/or Δ6-elongase.

To introduce the nucleic acids into the gene constructs, the nucleic acids used in the process are advantageously amplified and ligated in the known manner. Preferably, a procedure following the protocol for Pfu DNA polymerase or a Pfu/Taq DNA polymerase mixture is followed. The primers are selected taking into consideration the sequence to be amplified. The primers should expediently be chosen in such a way that the amplificate comprises the entire codogenic sequence from the start codon to the stop codon. After the amplification, the amplificate is expediently analyzed. For example, a gel-electrophoretic separation can be carried out, which is followed by a quantitative and a qualitative analysis. Thereafter, the amplificate can be purified following a standard protol (for example Qiagen). An aliquot of the purified amplificate is then available for the subsequent cloning step.

Suitable cloning vectors are generally known to the skilled worker. These include, in particular, vectors which are capable of replication in microbial systems, that is to say mainly vectors which ensure efficient cloning in yeasts or fungi and which make possible the stable transformation of plants. Those which must be mentioned in particular are various binary and cointegrated vector systems which are suitable for the T-DNA-mediated transformation. Such vector systems are, as a rule, characterized in that they comprise at least the vir genes required for the *Agrobacterium*-mediated transformation and the T-DNA-delimiting sequences (T-DNA border). These vector systems preferably also comprise further cis-regulatory regions such as promoters and terminator sequences and/or selection markers, by means of which suitably transformed organisms can be identified. While in the case of cointegrated vector systems vir genes and T-DNA sequences are arranged on the same vector, binary systems are based on at least two vectors, one of which bears vir genes, but no T-DNA, while a second one bears T-DNA, but no vir genes. Owing to this fact, the last-mentioned vectors are relatively small, easy to manipulate and capable of replication both in *E. coli* and in *Agrobacterium*. These binary vectors include vectors from the series pBIB-HYG, pPZP, pBecks, pGreen. In accordance with the invention, Bin19, pBI101, pBinAR, pGPTV and pCAMBIA are used by preference. An overview of the binary vectors and their use is found in Hellens et al, Trends in Plant Science (2000) 5, 446-451.

In order to prepare the vectors, the vectors can first be linearized with restriction endonuclease(s) and then modified enzymatically in a suitable manner. Thereafter, the vector is purified, and an aliquot is employed for the cloning step. In the cloning step, the enzymatically cleaved and, if appropriate, purified amplificate is ligated with vector fragments which have been prepared in a similar manner, using ligase. In this context, a particular nucleic acid construct, or vector or plasmid construct, can have one or more than one codogenic gene segments. The codogenic gene segments in these constructs are preferably linked functionally with regulatory sequences. The regulatory sequences include, in particular, plant sequences such as promoters and terminator sequences. The constructs can advantageously be stably propagated in microorganisms, in particular in *E. coli* and *Agrobacterium tumefaciens*, under selection conditions and make possible a transfer of heterologous DNA into plants or microorganisms.

The nucleic acids used in the process can be introduced into plants, advantageously using cloning vectors, and thus be used in the transformation of plants such as those which are published and cited therein: Plant Molecular Biology and Biotechnology (CRC Press, Boca Raton, Fla.), Chapter 6/7, p. 71-119 (1993); F. F. White, Vectors for Gene Transfer in Higher Plants; in: Transgenic Plants, Vol. 1, Engineering and Utilization, Eds.: Kung and R. Wu, Academic Press, 1993, 15-38; B. Jenes et al., Techniques for Gene Transfer, in: Transgenic Plants, Vol. 1, Engineering and Utilization, Eds.: Kung and R. Wu, Academic Press (1993), 128-143; Potrykus, Annu. Rev. Plant Physiol. Plant Molec. Biol. 42 (1991), 205-225. Thus, the nucleic acids and/or vectors used in the process can be used for the recombinant modification of a broad spectrum of plants so that the latter become better and/or more efficient PUFA producers.

A series of mechanisms by which a modification of the Δ12-desaturase, Δ5-elongase, Δ6-elongase, Δ5-desaturase and/or Δ6-desaturase protein is possible exists, so that the yield, production and/or production efficiency of the polyunsaturated fatty acids in a plant, preferably in an oilseed plant or oil crop, can be influenced directly owing to this modified protein. The number or activity of the Δ12-Desaturase, Δ6-desaturase, Δ5-elongase, Δ6-elongase or Δ5-desaturase proteins or genes can be increased, so that greater amounts of the gene products and, ultimately, greater amounts of the compounds of the general formula I are produced. A de novo synthesis in a plant which has lacked the activity and ability to biosynthesize the compounds prior to introduction of the corresponding gene(s) is also possible. This applies analogously to the combination with further desaturases or elongases or further enzymes of the fatty acid and lipid metabolism. The use of various divergent sequences, i.e. sequences which differ at the DNA sequence level, may also be advantageous in this context, or else the use of promoters which make possible a different gene expression in the course of time, for example as a function of the degree of maturity of a seed or an oil-storing tissue.

Owing to the introduction of a combination of Δ12-desaturase, Δ6-desaturase, Δ5-elongase, Δ6-elongase and/or Δ5-desaturase genes into the plant, alone or in combination with other genes, it is not only possible to increase biosynthesis flux towards the end product, but also to increase, or to create de novo the corresponding triacylglycerol composition. Likewise, the number or activity of other genes which are involved in the import of nutrients which are required for the biosynthesis of one or more fatty acids, oils, polar and/or neutral lipids, can be increased, so that the concentration of these precursors, cofactors or intermediates within the cells or within the storage compartment is increased, whereby the ability of the cells to produce PUFAs is enhanced further. By optimizing the activity or increasing the number of one or more Δ12-desaturase, Δ6-desaturase, Δ5-elongase, Δ6-elongase or Δ5-desaturase genes which are involved in the biosynthesis of these compounds, or by destroying the activity of one or more genes which are involved in the degradation of these compounds, an enhanced yield, production and/or production efficiency of fatty acid and lipid molecules in plants is made possible.

The nucleic acid sequences used in the process are advantageously introduced into an expression cassette which makes possible the expression of the nucleic acids in plants.

In doing so, the nucleic acid sequences which encode Δ12-desaturase, Δ6-desaturase, Δ5-elongase, Δ6-elongase or Δ5-desaturase are linked functionally with one or more regulatory signals, advantageously for enhancing gene expression. These regulatory sequences are intended to make possible the specific expression of the genes and proteins. Depending on the host organism, this may mean, for example, that the gene is expressed and/or overexpressed only after induction has taken place, or else that it is expressed and/or overexpressed immediately. For example, these regulatory sequences take the form of sequences to which inductors or repressors bind, thus controlling the expression of the nucleic acid. In addition to these novel regulatory sequences, or instead of these sequences, the natural regulatory elements of these sequences may still be present before the actual structural genes and, if appropriate, may have been genetically modified in such a way that their natural regulation is eliminated and the expression of the genes is enhanced. These modified promoters can also be positioned on their own before the natural gene in the form of part-sequences (=promotor with parts of the nucleic acid sequences used in accordance with the invention) in order to enhance the activity. Moreover, the gene construct may advantageously also comprise one or more what are known as enhancer sequences in operable linkage with the promoter, which make possible an enhanced expression of the nucleic acid sequence. Additional advantageous sequences, such as further regulatory elements or terminator sequences, may also be inserted at the 3' end of the DNA sequences.

The Δ12-desaturase, Δ5-desaturase, Δ6-desaturase, Δ5-elongase and/or Δ6-elongase genes may be present in one or more copies of the expression cassette (=gene construct). Preferably, only one copy of the genes is present in each expression cassette. This gene construct, or the gene constructs, can be expressed together in the host plant. In this context, the gene construct(s) can be inserted in one or more vectors and be present in the cell in free form, or else be inserted in the genome. It is advantageous for the insertion of further genes in the host genome when the genes to be expressed are present together in one gene construct.

In this context, the regulatory sequences or factors can, as described above, preferably have a positive effect on the gene expression of the genes introduced, thus enhancing it. Thus, an enhancement of the regulatory elements, advantageously at the transcriptional level, may take place by using strong transcription signals such as promoters and/or enhancers. In addition, however, enhanced translation is also possible, for example by improving the stability of the mRNA.

In a further embodiment of the invention, one or more gene constructs comprising one or more sequences which are defined by SEQ ID NO: 11, SEQ ID NO: 27, SEQ ID NO: 193, SEQ ID NO: 195, SEQ ID NO: 197, SEQ ID NO: 199, SEQ ID NO: 201 or their derivatives and which encode polypeptides as shown in SEQ ID NO: 12, SEQ ID NO: 28, SEQ ID NO: 194, SEQ ID NO: 196, SEQ ID NO: 198, SEQ ID NO: 200, SEQ ID NO: 202 are present. The abovementioned Δ12-desaturase, Δ6-desaturase, Δ5-elongase, Δ6-elongase or Δ5-desaturase proteins advantageously lead to a desaturation or elongation of fatty acids, the substrate advantageously having one, two, three or four double bonds and advantageously 18, 20 or 22 carbon atoms in the fatty acid molecule. The same applies to their homologs, derivatives or analogs which are linked functionally with one or more regulatory signals, preferably for enhancing gene expression.

In principle, it is possible to use all natural promoters together with their regulatory sequences, such as those mentioned above, for the novel process. It is also possible and advantageous to use synthetic promoters, either in addition or alone, in particular when they mediate seed-specific expression, such as those described in WO 99/16890.

In order to achieve a particularly high PUFA content, especially in transgenic plants, the PUFA biosynthesis genes should advantageously be expressed in oilseeds in a seed-specific manner. To this end, seed-specific promoters can be used, or those promoters which are active in the embryo and/or in the endosperm. In principle, seed-specific promoters can be isolated both from dicotyledonous and from monocotyledanous plants. Preferred promoters are listed hereinbelow: USP (=unknown seed protein) and vicilin (*Vicia faba*) [Bäumlein et al., Mol. Gen Genet., 1991, 225(3)], napin (oilseed rape) [U.S. Pat. No. 5,608,152], conlinin (linseed) [WO 02/102970], acyl carrier protein (oilseed rape) [U.S. Pat. No. 5,315,001 and WO 92/18634], oleosin (*Arabidopsis thaliana*) [WO 98/45461 and WO 93/20216], phaseolin (*Phaseolus vulgaris*) [U.S. Pat. No. 5,504,200], Bce4 [WO 91/13980], legumes B4 (LegB4 promoter) [Bäumlein et al., Plant J., 2,2, 1992], Lpt2 and Lpt1 (barley) [WO 95/15389 and WO95/23230], seed-specific promoters from rice, maize and wheat [WO 99/16890], Amy32b, Amy 6-6 and aleurain [U.S. Pat. No. 5,677,474], Bce4 (oilseed rape) [U.S. Pat. No. 5,530,149], glycinin (soybean) [EP 571 741], phosphoenol pyruvate carboxylase (soybean) [JP 06/62870], ADR12-2 (soybean) [WO 98/08962], isocitrate lyase (oilseed rape) [U.S. Pat. No. 5,689,040] or α-amylase (barley) [EP 781 849].

Plant gene expression can also be facilitated via a chemically inducible promoter (see a review in Gatz 1997, Annu. Rev. Plant Physiol. Plant Mol. Biol., 48:89-108). Chemically inducible promoters are particularly suitable when it is desired that gene expression should take place in a time-specific manner. Examples of such promoters are a salicylic-acid-inducible promoter (WO 95/19443), a tetracyclin-inducible promoter (Gatz et al. (1992) Plant J. 2, 397-404) and an ethanol-inducible promoter.

To ensure the stable integration of the biosynthesis genes into the transgenic plant over a plurality of generations, each of the nucleic acids which encode Δ12-desaturase, Δ6-desaturase, Δ5-elongase, Δ6-elongase and/or Δ5-desaturase and which are used in the process should be expressed under the control of a separate promoter, preferably a promoter which differs from the other promoters, since repeating sequence motifs can lead to instability of the T-DNA, or to recombination events. In this context, the expression cassette is advantageously constructed in such a way that a promoter is followed by a suitable cleavage site, advantageously in a polylinker, for insertion of the nucleic acid to be expressed and, if appropriate, a terminator sequence is positioned behind the polylinker. This sequence is repeated several times, preferably three, four, five, six or seven times, so that up to seven genes can be combined in one construct and introduced into the transgenic plant in order to be expressed. Advantageously, the sequence is repeated up to four times. To express the nucleic acid sequences, the latter are inserted behind the promoter via a suitable cleavage site, for example in the polylinker. Advantageously, each nucleic acid sequence has its own promoter and, if appropriate, its own terminator sequence. Such advantageous constructs are disclosed, for example, in DE 101 02 337 or DE 101 02 338. However, it is also possible to insert a plurality of nucleic acid sequences behind a shared promoter and, if appropriate, before a shared terminator sequence. Here, the insertion site, or the sequence, of the inserted nucleic acids in the expression cassette is not of critical importance, that is to say a nucleic acid sequence can be inserted at the first or last position in the cassette without its expression being substantially influenced thereby. Advantageously, different promoters such as, for example, the USP, LegB4 or DC3 promoter, and different terminator sequences can be used in the expression cassette. However, it is also possible to use only one type of promoter in the cassette, which, however, may lead to undesired recombination events.

As described above, the transcription of the genes which have been introduced should advantageously be terminated by suitable terminator sequences at the 3' end of the biosynthesis genes which have been introduced (behind the stop codon). An example of a sequence which can be used in this context is the OCS1 terminator sequence. As is the case with the promoters, different terminator sequences should be used for each gene.

As described above, the gene construct can also comprise further genes to be introduced into the plants. It is possible and advantageous to introduce into the host plants, and to express, regulatory genes such as genes for inductors, repressors or enzymes which, owing to their enzyme activity, engage in the regulation of one or more genes of a biosynthesis pathway. These genes can be of heterologous or of homologous origin.

Moreover, further biosynthesis genes of the fatty acid or lipid metabolism can advantageously be present in the nucleic acid construct, or gene construct; however, these genes can also be present on one or more further nucleic acid constructs. A biosynthesis gene of the fatty acid or lipid metabolism which is preferably chosen is a gene from the group consisting of acyl-CoA dehydrogenase(s), acyl-ACP [=acyl carrier protein] desaturase(s), acyl-ACP thioesterase(s), fatty acid acyl transferase(s), acyl-CoA:lysophospholipid acyltransferases, fatty acid synthase(s), fatty acid hydroxylase(s), acetyl-coenzyme A carboxylase(s), acyl-coenzyme A oxidase(s), fatty acid desaturase(s), fatty acid acetylenases, lipoxygenases, triacylglycerol lipases, allenoxide synthases, hydroperoxide lyases or fatty acid elongase(s) or combinations thereof.

Especially advantageous nucleic acid sequences are biosynthesis genes of the fatty acid or lipid metabolism selected from the group of the acyl-CoA:lysophospholipid acyltransferase, ω3-desaturase, Δ8-desaturase, Δ4-desaturase, Δ9-desaturase, Δ5-elongase and/or Δ9-elongase.

In this context, the abovementioned nucleic acids or genes can be cloned into expression cassettes, like those mentioned above, in combination with other elongases and desaturases and used for transforming plants with the aid of *Agrobacterium*.

Here, the regulatory sequences or factors can, as described above, preferably have a positive effect on, and thus enhance, the gene expression of the genes which have been introduced. Thus, enhancement of the regulatory elements can advantageously take place at the transcriptional level by using strong transcription signals such as promoters and/or enhancers. However, an enhanced translation is also possible, for example by improving the stability of the mRNA. In principle, the expression cassettes can be used directly for introduction into the plants or else be introduced into a vector.

These advantageous vectors, preferably expression vectors, comprise the nucleic acids which encode the Δ12-desaturases, Δ6-desaturases, Δ5-elongases, Δ6-elongases or Δ5-desaturases and which are used in the process, or else a nucleic acid construct which comprises the nucleic acid used either alone or in combination with further biosynthesis genes of the fatty acid or lipid metabolism such as the acyl-CoA: lysophospholipid acyltransferases, ω3-desaturases, Δ8-desaturases, Δ9-desaturases, ω3-desaturases, Δ4-desaturases, Δ5-elongases and/or Δ9-elongases.

As used in the present context, the term "vector" refers to a nucleic acid molecule which is capable of transporting another nucleic acid to which it is bound. One type of vector is a "plasmid", a circular double-stranded DNA loop into which additional DNA segments can be ligated. A further type of vector is a viral vector, it being possible for additional DNA segments to be ligated into the viral genome. Certain vectors are capable of autonomous replication in a host cell into which they have been introduced (for example bacterial vectors with bacterial replication origin). Other vectors are advantageously integrated into the genome of a host cell when they are introduced into the host cell, and thus replicate together with the host genome. Moreover, certain vectors can govern the expression of genes with which they are in operable linkage. These vectors are referred to in the present context as "expression vectors". Usually, expression vectors which are suitable for DNA recombination techniques take the form of plasmids. In the present description, "plasmid" and "vector" can be used exchangeably since the plasmid is the form of vector which is most frequently used. However, the invention is also intended to cover other forms of expression vectors, such as viral vectors, which exert similar functions. Furthermore, the term "vector" is also intended to encompass other vectors with which the skilled worker is familiar, such as phages, viruses such as SV40, CMV, TMV, transposons, IS elements, phasmids, phagemids, cosmids, linear or circular DNA.

The recombinant expression vectors advantageously used in the process comprise the nucleic acids or the described gene construct used in accordance with the invention in a form which is suitable for expressing the nucleic acids used in a host cell, which means that the recombinant expression vectors comprise one or more regulatory sequences, selected on the basis of the host cells used for the expression, which regulatory sequence(s) is/are linked functionally with the nucleic acid sequence to be expressed. In a recombinant expression vector, "linked functionally" or "in operable linkage" means that the nucleotide sequence of interest is bound to the regulatory sequence(s) in such a way that the expression of the nucleotide sequence is possible and they are bound to each other in such a way that both sequences carry out the predicted function which is ascribed to the sequence (for example in an in-vitro transcription/translation system, or in a host cell if the vector is introduced into the host cell).

The term "regulatory sequence" is intended to comprise promoters, enhancers and other expression control elements (for example polyadenylation signals). These regulatory sequences are described, for example, in Goeddel: Gene Expression Technology: Methods in Enzymology 185, Academic Press, San Diego, Calif. (1990), or see: Gruber and Crosby, in: Methods in Plant Molecular Biology and Biotechnology, CRC Press, Boca Raton, Fla., Eds.: Glick and Thompson, Chapter 7, 89-108, including the references cited therein. Regulatory sequences comprise those which govern the constitutive expression of a nucleotide sequence in many types of host cell and those which govern the direct expression of the nucleotide sequence only in specific host cells under specific conditions. The skilled worker knows that the design of the expression vector can depend on factors such as the choice of host cell to be transformed, the desired expression level of the protein and the like.

In a further embodiment of the process, the Δ12-desaturases, Δ6-desaturases, Δ5-elongases, Δ6-elongases and/or Δ5-desaturases can be expressed in single-celled plant cells (such as algae), see Falciatore et al., 1999, Marine Biotechnology 1 (3):239-251 and references cited therein, and in plant cells from higher plants (for example spermatophytes such as arable crops). Examples of plant expression vectors comprise those which are described in detail in: Becker, D., Kemper, E., Schell, J., and Masterson, R. (1992) "New plant binary vectors with selectable markers located proximal to the left border", Plant Mol. Biol. 20:1195-1197; and Bevan, M. W. (1984) "Binary *Agrobacterium* vectors for plant transformation", Nucl. Acids Res. 12:8711-8721; Vectors for Gene Transfer in Higher Plants; in: Transgenic Plants, Vol. 1, Engineering and Utilization, Eds.: Kung and R. Wu, Academic Press, 1993, p. 15-38.

A plant expression cassette preferably comprises regulatory sequences which are capable of governing the expression of genes in plant cells and which are linked functionally so that each sequence can fulfill its function, such as transcriptional termination, for example polyadenylation signals. Preferred polyadenylation signals are those which are derived from *Agrobacterium tumefaciens* T-DNA, such as gene 3 of the Ti plasmid pTiACH5 (Gielen et al., EMBO J. 3 (1984) 835 et seq.), which is known as octopine synthase, or functional equivalents thereof, but all other terminator sequences which are functionally active in plants are also suitable.

Since the regulation of plant gene expression is very often not limited to the transcriptional level, a plant expression cassette preferably comprises other sequences which are linked functionally, such as translation enhancers, for example the overdrive sequence, which enhances the tobacco mosaic virus 5'-untranslated leader sequence, which increases the protein/RNA ratio (Gallie et al., 1987, Nucl. Acids Research 15:8693-8711).

As described above, the gene to be expressed must be linked functionally with a suitable promoter which triggers gene expression with the correct planning or in a cell- or tissue-specific manner. Utilizable promoters are constitutive promoters (Benfey et al., EMBO J. 8 (1989) 2195-2202), such as those which are derived from plant viruses, such as 35S CaMV (Franck et al., Cell 21 (1980) 285-294), 19S CaMV (see also U.S. Pat. No. 5,352,605 and WO 84/02913), or constitutive plant promoters, such as the promoter of the Rubisco small subunit, which is described in U.S. Pat. No. 4,962,028.

As described above, plant gene expression can also be achieved via a chemically inducible promoter (see a review in Gatz 1997, Annu. Rev. Plant Physiol. Plant Mol. Biol., 48:89-108). Chemically inducible promoters are particularly suitable when it is desired that the gene expression takes place in a time-specific manner. Examples of such promoters are a salicylic-acid-inducible promoter (WO 95/19443), a tetracyclin-inducible promoter (Gatz et al. (1992) Plant J. 2, 397-404) and an ethanol-inducible promoter.

Promoters which respond to biotic or abiotic stress conditions are also suitable, for example the pathogen-induced PRP1 gene promoter (Ward et al., Plant. Mol. Biol. 22 (1993) 361-366), the heat-inducible tomato hsp80 promoter (U.S. Pat. No. 5,187,267), the chill-inducible potato alpha-amylase promoter (WO 96/12814) or the wound-inducible pinII promoter (EP-A-0 375 091).

Especially preferred are those promoters which bring about the gene expression in tissues and organs in which the biosynthesis of fatty acids, lipids and oils takes place, in seed cells, such as cells of the endosperm and of the developing embryo. Suitable promoters are the oilseed rape napin promoter (U.S. Pat. No. 5,608,152), the linseed Conlinin promoter (WO 02/102970), the *Vicia faba* USP promoter (Baeumlein et al., Mol Gen Genet, 1991, 225 (3):459-67), the *Arabidopsis* oleosin promoter (WO 98/45461), the *Phaseolus vulgaris* phaseolin promoter (U.S. Pat. No. 5,504, 200), the *Brassica* Bce4 promoter (WO 91/13980) or the legume B4 promoter (LeB4; Baeumlein et al., 1992, Plant Journal, 2 (2):233-9), and promoters which bring about the seed-specific expression in monocotyledonous plants such as maize, barley, wheat, rye, rice and the like. Suitable noteworthy promoters are the barley Ipt2 or Ipt1 gene promoter (WO 95/15389 and WO 95/23230) or the promoters from the barley hordein gene, the rice glutelin gene, the rice oryzin gene, the rice prolamine gene, the wheat gliadine gene, the wheat glutelin gene, the maize zeine gene, the oat glutelin gene, the *sorghum kasirin* gene or the rye secalin gene, which are described in WO 99/16890.

Other promoters which are also particularly suitable are those which bring about the plastid-specific expression, since plastids constitute the compartment in which precursors and some end products of lipid biosynthesis are synthesized. Suitable promoters are the viral RNA polymerase promoter, described in WO 95/16783 and WO 97/06250, and the *Arabidopsis* clpP promoter, described in WO 99/46394.

In particular, it may be desired to bring about the multi-parallel expression of the Δ12-desaturases, Δ6-desaturases, Δ5-elongases, Δ6-elongases and/or Δ5-desaturases used in the process. Such expression cassettes can be introduced via the simultaneous transformation of a plurality of individual expression constructs or, preferably, by combining a plurality of expression cassettes on one construct. Also, a plurality of vectors can be transformed with in each case a plurality of expression cassettes and then transferred into the host cell.

Other preferred sequences for the use in operable linkage in plant gene expression cassettes are targeting sequences which are required for targeting the gene product into its corresponding cell compartment, for example into the vacuole, the nucleus, all types of plastids, such as amyloplasts, chloroplasts, chromoplasts, the extracellular space, the mitochondria, the endoplasmic reticulum, elaioplasts, peroxisomes and other compartments of plant cells (see a review in Kermode, Crit. Rev. Plant Sci. 15, 4 (1996) 285-423 and references cited therein).

The process according to the invention employs the nucleic acid sequences with the SEQ ID NO: 11, SEQ ID NO: 27, SEQ ID NO: 193, SEQ ID NO: 195, SEQ ID NO: 197, SEQ ID NO: 199, SEQ ID NO: 201 or their derivatives or homologs which encode polypeptides which retain the enzymatic activity of the proteins encoded by nucleic acid sequences. These sequences, individually or in combination with the nucleic acid sequences which encode the other enzymes used, are cloned into expression constructs and used for the transformation into, and expression in, plants. Owing to their construction, these expression constructs make possible an advantageous optimal synthesis of the polyunsaturated fatty acids produced in the process according to the invention.

In a preferred embodiment, the process furthermore comprises the step of obtaining a cell or an intact plant which comprises the nucleic acid sequences used in the process, where the cell and/or the plant is transformed with a nucleic acid sequence encoding a polypeptide with a Δ12-desaturase, Δ5-desaturase, Δ6-desaturase, Δ5-elongase and/or Δ6-elongase activity, a gene construct or a vector as described above, alone or in combination with further nucleic acid sequences which encode proteins of the fatty acid or lipid metabolism. The resulting cell is advantageously a cell of an oil-producing organism such as an oil crop, such as, for example, peanut, oilseed rape, canola, linseed, hemp, peanut, soybean, safflower, hemp, mustard, sunflowers or borage.

For the purposes of the invention, "transgenic" or "recombinant" means with regard to, for example, a nucleic acid sequence, an expression cassette (=gene construct) or a vector comprising the nucleic acid sequence according to the invention or an organism transformed with the nucleic acid sequences, expression cassettes or vectors according to the invention, all those constructions brought about by recombinant methods in which either a) the nucleic acid sequence according to the invention, or b) a genetic control sequence which is operably linked with the nucleic acid sequence according to the invention, for example a promoter, or c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original organism or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences used in the process according to the invention with the corresponding Δ12-desaturase, Δ4-desaturase, Δ5-desaturase, Δ6-desaturase, Δ8-desaturase, ω3-desaturase, Δ9-elongase, Δ6-elongase and/or Δ5-elongase genes—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

Transgenic plants for the purposes of the invention is therefore understood as meaning that the nucleic acids used in the process are not at their natural locus in the genome of the plant, it being possible for the nucleic acids to be expressed homologously or heterologously. However, transgenic also means that, while the nucleic acids according to the invention are at their natural position in the genome of the plant, however, the sequence having been modified with regard to the natural sequence, and/or that the regulatory sequences of the natural sequences have been modified. Transgenic is preferably understood as meaning the expression of the nucleic acids according to the invention or the nucleic acid sequences used in the process according to the invention at an unnatural locus in the genome, i.e. homologous or, preferably, heterologous expression of the nucleic acids takes place. Preferred transgenic plants are oilseed or oil fruit crops.

Plants which are suitable for use in the process according to the invention are, in principle, advantageously all plants which are capable of synthesizing fatty acids, specifically unsaturated fatty acids such as ARA, EPA and/or DHA, and which are suitable for the expression of recombinant genes. Examples are plants such as *Arabidopsis*, Asteraceae such as *Calendula* or crop plants such as soybean, peanut, castor-oil plant, sunflower, maize, cotton, flax, oilseed rape, coconut, oil palm, safflower (*Carthamus tinctorius*) or cacao bean. Plants which are naturally capable of synthesizing large amounts of oils are preferred, such as soybean, oilseed rape, *Camelina*, Indian mustard, coconut, oil palm, safflower (*Carthamus tinctorius*), flax, hemp, castor-oil plant, *Calendula*, peanut, cacao bean or sunflower or yeast such as *Saccharomyces cerevisiae*, with soybean, flax, oilseed rape, safflower, sunflower, *Camelina*, indian mustard or *Calendula* being especially preferred.

Further host cells which can be used for cloning the nucleic acid sequences used in the process according to the invention are detailed in: Goeddel, Gene Expression Technology: Methods in Enzymology 185, Academic Press, San Diego, Calif. (1990).

Expression strains which can be used, for example those with a lower protease activity, are described in: Gottesman, S., Gene Expression Technology: Methods in Enzymology 185, Academic Press, San Diego, Calif. (1990) 119-128.

These include plant cells and certain tissues, organs and parts of plants in all their phenotypic forms such as anthers, fibers, root hairs, stalks, embryos, calli, cotelydons, petioles, harvested material, plant tissue, reproductive tissue and cell cultures which is derived from the actual transgenic plant and/or can be used for bringing about the transgenic plant.

Transgenic plants or advantageously the seeds thereof which comprise the polyunsaturated fatty acids in particular ARA, EPA and/or DHA, synthesized in the process according to the invention can advantageously be marketed directly without there being any need for the oils, lipids or fatty acids synthesized to be isolated. Plants for the process according to the invention are as meaning intact plants and all plant parts, plant organs or plant parts such as leaf, stem, seeds, root, tubers, anthers, fibers, root hairs, stalks, embryos, calli, cotelydons, petioles, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue.

In principle, the process according to the invention is also suitable for the production of polyunsaturated fatty acids, in particular ARA, EPA and/or DHA, in plant cell cultures, followed by obtaining the fatty acids from the cultures. In particular, they may take the form of suspension or callus cultures.

However, the compound produced in the process according to the invention can also be isolated from the plants, advantageously the plant seeds, in the form of their oils, fat, lipids and/or free fatty acids. Polyunsaturated fatty acids produced by this process, in particular ARA, EPA and/or DHA, can be harvested by harvesting the plants or plant seeds either from the culture in which they grow, or from the field.

In a further preferred embodiment, this process furthermore comprises the step of obtaining the oils, lipids or free fatty acids from the plant or from the crop. The crop may, for example, take the form of a greenhouse- or field-grown plant crop.

The oils, lipids or free fatty acids can be isolated via pressing or extraction of the plant parts, preferably the plant seeds. In this context, the oils, fats, lipids and/or free fatty acids can be obtained by what is known as cold-beating or cold-pressing without applying heat. To allow for greater ease of disruption of the plant parts, specifically the seeds, they are previously comminuted, steamed or roasted. The seeds which have been pretreated in this manner can subsequently be pressed or extracted with solvents such as warm hexane. The solvent is subsequently removed.

Thereafter, the resulting products which comprise the polyunsaturated fatty acids are processed further, i.e. refined. In this process, substances such as the plant mucilages and suspended matter are first removed. What is known as desliming can be effected enzymatically or, for example, chemico-physically by addition of acid such as phosphoric acid. Thereafter, the free fatty acids are removed by treatment with a base, for example sodium hydroxide solution. The resulting product is washed thoroughly with water to remove the alkali remaining in the product and then dried. To remove the pigment remaining in the product, the products are subjected to bleaching, for example using fuller's earth or active charcoal. At the end, the product is deodorized, for example using steam.

The PUFAs or LCPUFAs produced by this process are preferably $C_{18}$-, $C_{20}$- or $C_{22}$-fatty acid molecules, advantageously $C_{20}$- or $C_{22}$-fatty acid molecules, with at least two double bonds in the fatty acid molecule, preferably with three, four, five or six double bonds, especially preferably with four, five or six double bonds. These $C_{18}$-, $C_{20}$- or $C_{22}$-fatty acid molecules can be isolated from the plant in the form of an oil, a lipid or a free fatty acid. Examples of suitable plants are those mentioned above. Suitable organisms are transgenic plants.

One embodiment of the invention are therefore oils, lipids or fatty acids or fractions thereof which have been prepared by the above-described process, especially preferably oils, lipids or a fatty acid composition which comprise PUFAs and originate from transgenic plants.

The fatty acids obtained in the process are also suitable as starting material for the chemical synthesis of products of value. For example, they can be used together or alone for the production of pharmaceuticals, foodstuffs, feedstuffs or cosmetics.

As described above, these oils, lipids or fatty acids advantageously comprise 6 to 15% of palmitic acid, 1 to 6% of stearic acid, 7-85% of oleic acid, 0.5 to 8% of vaccenic acid, 0.1 to 1% of arachic acid, 7 to 25% of saturated fatty acids, 8 to 85% of monounsaturated fatty acids and 60 to 85% of polyunsaturated fatty acids, in each case based on 100% and on the total fatty acid content of the organisms. Advantageous polyunsaturated fatty acids which are present in the fatty acid esters or fatty acid mixtures are preferably at least 0.1, 0.2, 0.3, 0.4, 0.5, 0.6, 0.7, 0.8, 0.9 or 1% of arachidonic acid, based on the total fatty acid content. Moreover, the fatty acid esters or fatty acid mixtures which have been produced by the process of the invention advantageously comprise fatty acids selected from the group of the fatty acids erucic acid (13-docosaenoic acid), sterculic acid (9,10-methyleneoctadec-9-enoic acid), malvalic acid (8,9-methyleneheptadec-8-enoic acid), chaulmoogric acid (cyclopentenedodecanoic acid), furan fatty acid (9,12-epoxyoctadeca-9,11-dienoic acid), vernolic acid (9,10-epoxyoctadec-12-enoic acid), tariric acid (6-octadecynoic acid), 6-nonadecynoic acid, santalbic acid (t11-octadecen-9-ynoic acid), 6,9-octadecenynoic acid, pyrulic acid (t10-heptadecen-8-ynoic acid), crepenyninic acid (9-octadecen-12-ynoic acid), 13,14-dihydrooropheic acid, octadecen-13-ene-9,11-diynoic acid, petroselenic acid (cis-6-octadecenoic acid), 9c,12t-octadecadienoic acid, calendulic acid (8t10t12c-octadecatrienoic acid), catalpic acid (9t11t13c-octadecatrienoic acid), eleostearic acid (9c11t13t-octadecatrienoic acid), jacaric acid (8c10t12c-octadecatrienoic acid), punicic acid (9c11t13c-octadecatrienoic acid), parinaric acid (9c11t13t15c-octadecatetraenoic acid), pinolenic acid (all-cis-5,9,12-octadecatrienoic acid), laballenic acid (5,6-octadecadienallenic acid), ricinoleic acid (12-hydroxyoleic acid) and/or coriolic acid (13-hydroxy-9c,11t-octadecadienoic acid). The abovementioned fatty acids are, as a rule, advantageously only found in traces in the fatty acid esters or fatty acid mixtures produced by the process according to the invention, that is to say that, based on the total fatty acids, they occur to less than 30%, preferably to less than 25%, 24%, 23%, 22% or 21%, especially preferably to less than 20%, 15%, 10%, 9%, 8%, 7%, 6% or 5%, very especially preferably to less than 4%, 3%, 2% or 1%. In a further preferred form of the invention, these abovementioned fatty acids occur in amounts of less than 0.9%, 0.8%, 0.7%, 0.6% or 0.5%, especially preferably less than 0.4%, 0.3%, 0.2%, 0.1%, based on the total fatty acids. The fatty acid esters or fatty acid mixtures produced by the process according to the invention advantageously comprise less than 0.1%, based on the total fatty acids, and/or no butyric acid, no cholesterol, no clupanodonic acid (=docosapentaenoic acid, $C22:5^{\Delta4,8,12,15,21}$) and no nisinic acid (tetracosahexaenoic acid, $C23:6^{\Delta3,8,12,15,18,21}$).

As a rule, the abovementioned fatty acids are advantageously only found in traces in the fatty acid esters or fatty acid mixtures produced by the process according to the invention, that is to say that, based on the total fatty acids, they are found in amounts of less than 30%, preferably less than 25%, 24%, 23%, 22% or 21%, especially preferably less than 20%, 15%, 10%, 9%, 8%, 7%, 6% or 5%, very especially preferably less than 4%, 3%, 2% or 1%. In a further preferred embodiment of the invention, these abovementioned fatty acids are found relative to the total fatty acids in amounts of less than 0.9%, 0.8%, 0.7%, 0.6% or 0.5%, especially preferably less than 0.4%, 0.3%, 0.2%, 0.1%. The fatty acid esters or fatty acid mixtures produced by the process according to the invention advantageously comprise less than 0.1% based on the total fatty acids and/or no butyric acid, no cholesterol, no clupanodonic acid (=docosapentaenoic acid, $C22:5^{\Delta4,8,12,15,21}$) and no nisinic acid (tetracosahexaenoic acid, $C23:6^{\Delta3,8,12,15,18,21}$).

The oils, lipids or fatty acids according to the invention advantageously comprise at least 0.5%, 1%, 2%, 3%, 4%, 5%, 6%, 7%, 8%, 9% or 10%, advantageously at least 11%, 12%, 13%, 14%, 15%, 16% or 17%, especially advantageously at least 18%, 19%, 20%, 21%, 22%, 23%, 24% or 25% of ARA or at least 0.5%, 1%, 2%, 3%, 4%, 5% or 6%, advantageously at least 7%, 8%, 9%, 10% or 11%, especially advantageously at least 12%, 13%, 14%, 15%, 16%, 17%, 18%, 19% or 20% of EPA or at least 0.01%, 0.02%, 0.03%, 0.04% or 0.05% or 0.06%, advantageously at least 0.07%, 0.08%, 0.09% or 0.1%, especially advantageously at least 0.2%, 0.3% or 0.4% of DHA, based on the total fatty acid content of the production organism, advantageously of a plant, especially advantageously of an oil crop such as soybean, oilseed rape, coconut, oil palm, safflower, flax, hemp, castor-oil plant, *Calendula*, peanut, cacao bean, sunflower or the abovementioned other monocotyledonous or dicotyledonous oil crops. All percentages are by weight.

Owing to the nucleic acid sequences according to the invention, or the nucleic acid sequences used in the process according to the invention, it is possible to obtain an increase in the yield of polyunsaturated fatty acids, mainly ARA and EPA, but also DHA, of at least 50, 80 or 100%, advantageously at least 150, 200 or 250%, especially advantageously at least 300, 400, 500, 600, 700, 800 or 900%, very advantageously at least 1000, 1100, 1200, 1300, 1400 or 1500% in comparison with the non-transgenic starting plant, for example a plant such as *Brassica juncea, Brassica napus, Camelina sativa, Arabidopsis thanliana* or *Linum usitatissimum* when using a GC analysis for comparison purposes, see Examples.

The lipids and/or oils produced in the process according to the invention have a higher content of the unsaturated fatty acids oleic acid, linoleic acid and α-linolenic acid in the sn2-position in comparison with the other positions sn1 and sn3. A higher content is understood as meaning ratios of (sn1:sn2:sn3) 1:1.1:1, 1:1.5:1 to 1:3:1. Also, the arachidonic acid, eicosapentaenoic acid or docosahexaenoic acid produced in the process likewise show, in the lipids and/or oils, a preference for the sn2-position in the triglyceride in comparison with the positions sn1 and sn3 of advantageously 1:1.1:1, 1:1.5:1 to 1:3:1.

As described above, the polyunsaturated $C_{20}$- and/or $C_{22}$-fatty acids, produced in the process, with four, five or six double bonds in the molecule will in the seed of plants which comprise no, or only very small amounts, of C12:0- or C14:0-fatty acids. Even shorter saturated fatty acids such as the fatty acids C4:0, C6:0, C8:0 or C10:0, too, should not be present in the lipid and/or oil, or only in small amounts. Only small amounts are understood as meaning, advantageously, amounts which, when analyzed by GC, advantageously amount to less than 5, 4, 3, 2 or 1%, advantageously less than 0.9, 0.8, 0.7, 0.6 or 0.5%, especially advantageously less than 0.4, 0.3, 0.2 or 0.1%, very especially preferably less than 0.09, 0.08, 0.07, 0.06, 0.05, 0.04, 0.03, 0.02 or 0.01 units GC peak area. The fatty acid C16:0 should advantageously be in the range of from 1 to 28% units GC peak area. Advantageously, the fatty acid C16:0 should be present in amounts of less than 25%, 20%, 15% or 10%, advantageously less than 9%, 8%, 7%, 6% or 5%, especially advantageously of less than 4%, 3%, 2% or 1% units GC peak area or not at all in the lipids, oils and/or free fatty acids. The fatty acid C16:1 should advantageously amount to less than 1, 0.5, 0.4, 0.3, 0.2 or 0.1%, especially advantageously 0.09, 0.08, 0.07, 0.06, 0.05, 0.04, 0.03, 0.02 or 0.01 units GC peak area. Very especially preferably, the fatty acid C16:1 should not be present in the oils and/or lipids produced in the process. The same applies to the fatty acids C15:0, C17:0, $C16:1^{\Delta3}$trans, $C16:4^{\Delta4,7,10,13}$ and $C18:5^{\Delta3,6,9,12,15}$. Besides oleic acid ($C18:1^{\Delta9}$), the isomers ($C18:1^{\Delta7}$, $C18:1^{\Delta11}$) may also be present in the lipids, oils or free fatty acids. Advantageously in amounts of less than 5%, 4%, 3%, 2% or 1%, measured as units GC peak area. Each of the fatty acids C20:0, C20:1, C24:0 and C24:1 should be present in a range of from 0 to 1%, 0 to 3% and 0 to 5% units GC peak area, respectively. Moreover, little dihomo-γ-linolenic acid (=DGLA) in terms of units GC peak area should be detectable in the seed oil and/or seed lipid in the GC analysis. Little is understood as meaning less than 2, 1.9, 1.8, 1.7, 1.6 and 1.5%, advantageously less than 1.4, 1.3, 1.2, 1.1 or 1%, especially advantageously less than 0.9, 0.8, 0.7, 0.6, 0.5 or 0.4% in terms of units GC peak area.

In a preferred embodiment of the process, DGLA and ARA should be produced in a ratio of from 1:1 up to 1:100, advantageously 1:2 up to 1:80, especially advantageously 1:3 up to 1:70, very especially preferably 1:5 up to 1:60.

In a further preferred embodiment of the process, DGLA and EPA should be produced in a ratio of from 1:1 up to 1:100, advantageously 1:2 up to 1:80, especially advantageously 1:3 up to 1:70, very especially preferably 1:5 up to 1:60.

The lipids, oils and/or free fatty acids produced in the process according to the invention should advantageously have a high content of unsaturated fatty acids, advantageously of polyunsaturated acids, of at least 30, 40 or 50% by weight, advantageously of at least 60, 70 or 80% by weight, based on the total fatty acid content in the seeds of the transgenic plants.

All saturated fatty acids together should advantageously only account for a small amount in the lipids, oils and/or free fatty acids, preferably used plants. In this context, a small amount is understood as meaning an amount of less than 15%, 14%, 13%, 12%, 11% or 10%, preferably less than 9%, 8%, 7% or 6% in units GC peak area.

Lipids, oils and/or free fatty acids produced in the process should advantageously have an erucic acid content of less than 2% by weight based on the total fatty acid content of the plant. Advantageously, no erucic acid should be present in the lipids and/or oils. Also, the content of saturated fatty acids C16:0 and/or C18:0 should advantageously be less than 19, 18, 17, 16, 15, 14, 13, 12, 11 or 10% by weight, advantageously less than 9, 8, 7, 6 or 5% by weight, based on the total fatty acid content of the lipids and/or oils. Also, longer fatty acids such as C20:0 or C22:1 should not be present at all or only in small amounts of advantageously less than 4, 3, 2 or 1% by weight, advantageously less than 0.9, 0.8, 0.7, 0.6, 0.5, 0.4, 0.3, 0.2 or 0.1% by weight, based on the total fatty acid content of the lipids and/or oils. Typically, no, or only small amounts, of C16:1 are present as fatty acid in the lipids and/or oils produced in the process according to the invention. Small amounts are advantageously understood as meaning fatty acid contents of less than 4, 3, 2 or 1% by weight, advantageously less than 0.9, 0.8, 0.7, 0.6, 0.5, 0.4, 0.3, 0.2 or 0.1% by weight, based on the total fatty acid content of the lipids and/or oils.

The oils, lipids, fatty acids or fatty acid mixtures according to the invention which are obtained after pressing are referred to as what is known as crude oils. They still comprise all of the oil and/or lipid contents and also compounds which are soluble in these. Such compounds are the various tocopherols such as α-tocopherol, β-tocopherol, γ-tocopherol and/or δ-tocopherol or phytosterols such as brassicasterol, campesterol, stigmasterol, β-sitosterol, sitostanol, $\Delta^5$-avenasterol, $\Delta^5$,24-stigmastadienol, $\Delta^7$-stigmasternol or $\Delta^7$-avenasterol. These compounds are present in a range of from 1 to 1000 mg/100 g, advantageously 10 to 800 mg/100 g of lipid or oil. Triterpenes such as germaniol, amyrin, cycloartenol and others may also be present in these lipids and oils. These lipids and/or oils comprise the polyunsaturated fatty acids produced in the process, such as ARA, EPA and/or DHA, bound in polar and unpolar lipids such as phospholipids, for example phosphatidylcholine, phosphatidylethanolamine, phosphatidiylinositol, phosphatidylserine, phosphatidylglycerol, galactolipids, monoglycerides, diglycerides or triglycerides, to mention but a few. Lysophospholipids may also be present in the lipids and/or oils. These components of the lipids and/or oils can be separated from one another by suitable processes. Cholesterol is not present in these crude oils.

A further embodiment according to the invention is the use of the oil, lipid, fatty acids and/or the fatty acid composition in feedstuffs, foodstuffs, cosmetics or pharmaceuticals. The oils, lipids, fatty acids or fatty acid mixtures according to the invention can be used in the manner with which the skilled worker is familiar for mixing with other oils, lipids, fatty acids or fatty acid mixtures of animal origin such as, for example, fish oils. Typical of such fish oils short-chain fatty acids such as C12:0, C14:0, C14:1, branched C15:0, C15:0, C16:0 or C16:1. Polyunsaturated C16-fatty acids such as C16:2, C16:3 or C16:4, branched C17:0, C17:1, branched C18:0 and C19:0 and also C19:0 and C19:1 are also found in fish oil. Such fatty acids are typical of fish oils and are only found rarely, or not at all, in vegetable oils. Economically relevant fish oils are, for example, anchovy oil, menhaden oil, tuna oil, sardine oil, herring oil, mackerel oil, whale oil and salmon oil. These lipids and/or oils of animal origin can be used for mixing with the oils according to the invention in the form of crude oils, i.e. in the form of lipids and/or oils which have not yet been purified, or else various purified fractions may be used for mixing.

A further embodiment according to the invention is the use of the oil, lipid, fatty acids and/or fatty acid compositions in feedstuffs, foodstuffs, cosmetics or pharmaceuticals.

The oils, lipids, fatty acids or fatty acid mixtures according to the invention can be used in the manner with which the skilled worker is familiar for mixing with other oils, lipids, fatty acids or fatty acid mixtures of animal origin such as, for example, fish oils. Again, these oils, lipids, fatty acids or fatty acid mixtures, which are composed of vegetable and animal constituents, may be used for the preparation of foodstuffs, feedstuffs, cosmetics or pharmaceuticals.

The term "oil", "lipid" or "fat" is understood as meaning a fatty acid mixture comprising unsaturated or saturated, preferably esterified, fatty acid(s). The oil, lipid or fat is preferably high in polyunsaturated free or, advantageously, esterified fatty acid(s), in particular linoleic acid, γ-linolenic acid, dihomo-γ-linolenic acid, arachidonic acid, α-linolenic acid, stearidonic acid, eicosatetraenoic acid, eicosapentaenoic acid, docosapentaenoic acid or docosahexaenoic acid. The amount of unsaturated esterified fatty acids preferably amounts to approximately 30%, a content of 50% is more preferred, a content of 60%, 70%, 80%, 85% or more is even more preferred. For the analysis, the fatty acid content can, for example, be determined by gas chromatography after converting the fatty acids into the methyl esters by transesterification. The oil, lipid or fat can comprise various other saturated or unsaturated fatty acids, for example calendulic acid, palmitic acid, palmitoleic acid, stearic acid, oleic acid and the like. The content of the various fatty acids in the oil or fat can vary, in particular depending on the starting organism.

The polyunsaturated fatty acids with advantageously at least two double bonds which are produced in the process are, as described above, for example sphingolipids, phosphoglycerides, lipids, glycolipids, phospholipids, monoacylglycerol, diacylglycerol, triacylglycerol or other fatty acid esters.

Starting from the polyunsaturated fatty acids with advantageously at least five or six double bonds, which acids have been prepared in the process according to the invention, the polyunsaturated fatty acids which are present can be liberated for example via treatment with alkali, for example aqueous KOH or NaOH, or acid hydrolysis, advantageously in the presence of an alcohol such as methanol or ethanol, or via enzymatic cleavage, and isolated via, for example, phase separation and subsequent acidification via, for example, $H_2SO_4$. The fatty acids can also be liberated directly without the above-described processing step.

Mosses and algae are the only known plant systems which produce substantial amounts of polyunsaturated fatty acids such as arachidonic acid (ARA) and/or eicosapentaenoic acid (EPA) and/or docosahexaenoic acid (DHA). Mosses comprise PUFAs in membrane lipids, while algae, organisms which are related to algae and a few fungi also accumulate substantial amounts of PUFAs in the triacylglycerol fraction. This is why nucleic acid molecules which are isolated from such strains which also accumulate PUFAs in the triacylglycerol fraction are particularly advantageous for the process according to the invention and thus for the modification of the lipid and PUFA production system in a host, in particular plants such as oil crops, for example oilseed rape, canola, linseed, hemp, soybeans, sunflowers and borage. They can therefore be used advantageously in the process according to the invention.

After their introduction into a plant cell or plant, the nucleic acids used in the process can either be present on a separate plasmid or, advantageously, integrated into the genome of the host cell. In the case of integration into the genome, integration can be random or else be effected by recombination such that the native gene is replaced by the copy introduced, whereby the production of the desired compound by the cell is modulated, or by the use of a gene in trans, so that the gene is linked operably with a functional expression unit which comprises at least one sequence which ensures the expression of a gene and at least one sequence which ensures the polyadenylation of a functionally transcribed gene. The nucleic acids are advantageously introduced into the organisms via multiexpression cassettes or constructs for multiparallel expression, advantageously into the plants for the multiparallel seed-specific expression of genes.

Naturally, the coexpression of a plurality of genes can be effected not only by introducing the genes on a shared recombinant nucleic acid construct. Rather, individual genes can also be introduced separately—simultaneously or in succession, on a variety of constructs. In this case, the simultaneous presence in the plant which coexpresses all of the genes is ensured by using different selection markers. This plant can be the product of one or more transformation procedures, or else be a hybridization product of plants comprising one or more of the genes.

Substrates which are advantageously suitable for the nucleic acids which are used in the process according to the invention and which encode polypeptides with ω3-desaturase, Δ4-desaturase, Δ5-desaturase, Δ6-desaturase, Δ8-desaturase, Δ12-desaturase, Δ5-elongase, Δ6-elongase and/or Δ9-elongase activity and/or the further nucleic acids used, such as the nucleic acids which encode polypeptides of the fatty acid or lipid metabolism selected from the group acyl-CoA dehydrogenase(s), acyl-ACP [=acyl carrier protein] desaturase(s), acyl-ACP thioesterase(s), fatty acid acyltransferase(s), acyl-CoA: lysophospholipid acyltransferase(s), fatty acid synthase(s), fatty acid hydroxylase(s), acetyl-coenzyme A carboxylase(s), acyl-coenzyme A oxidase(s), fatty acid desaturase(s), fatty acid acetylenases, lipoxygenases, triacylglycerol lipases, allenoxide synthases, hydroperoxide lyases or fatty acid elongase(s) are advantageously $C_{16}$-, $C_{18}$-, $C_{20}$- or $C_{22}$-fatty acids. The fatty acids converted as substrates in the process are preferably converted in the form of their acyl-CoA esters and/or their phospholipid esters. It is advantageous to use, in the process, desaturases with specificity for the acyl-CoA esters. The advantage here is that a substitution between the phospholipid esters, which are generally the substrate of the desaturation, and the acyl-CoA esters, can be dispensed with. Thus, a further enzyme step which, as has been shown, is limiting in some cases, can be dispensed with.

To produce the long-chain PUFAs according to the invention, the polyunsaturated $C_{16}$- or $C_{18}$-fatty acids must first be desaturated by the enzymatic activity of a desaturase and subsequently be elongated by at least two carbon atoms via an elongase. After one elongation cycle, this enzyme activity gives $C_{18}$- or $C_{20}$-fatty acids and after two elongation cycles $C_{20}$- or $C_{22}$-fatty acids. The activity of the desaturases and elongases used in the process according to the invention preferably leads to $C_{18}$-, $C_{20}$- and/or $C_{22}$-fatty acids, advantageously with at least two double bonds in the fatty acid molecule, preferably with three, four, five or six double bonds, especially preferably to give $C_{20}$- and/or $C_{22}$-fatty acids with at least three double bonds in the fatty acid molecule, preferably with three, four, five or six double bonds, very specially preferably with four, five or six double bonds in the molecule. Products of the process according to the invention which are especially preferred are arachidonic acid, eicosapentaenoic acid and/or docosahexaenoic acid. The $C_{18}$-fatty acids with at least two double bonds in the fatty acid can be elongated by the enzymatic activity according to the invention in the form of the free fatty acid or in the form of the esters, such as phospholipids, glycolipids, sphingolipids, phosphoglycerides, monoacylglycerol, diacylglycerol or triacylglycerol.

The preferred biosynthesis site of the fatty acids, oils, lipids or fats in the plants which are advantageously used is, for example, in general the seed or cell strata of the seed, so that seed-specific expression of the nucleic acids used in the process makes sense. However, it is obvious that the biosynthesis of fatty acids, oils or lipids need not be limited to the seed tissue, but can also take place in a tissue-specific manner in all the other parts of the plant, for example in epidermal cells or in the tubers.

Owing to the use of the nucleic acids according to the invention which encode a Δ5-elongase, the polyunsaturated fatty acids produced in the process can be increased by at least 5%, preferably by at least 10%, especially preferably by at least 20%, very especially preferably by at least 50% in comparison with the wild type of the organisms which do not comprise the nucleic acids recombinantly.

In principle, the polyunsaturated fatty acids produced by the process according to the invention in the plants used in the process can be increased in two different ways. Either the pool of free polyunsaturated fatty acids and/or the content of the esterified polyunsaturated fatty acids produced via the process can be enlarged. Advantageously, the pool of esterified polyunsaturated fatty acids in the transgenic organisms is enlarged by the process according to the invention.

A further subject matter according to the invention are isolated nucleic acid sequences which encode polypeptides with Δ5-elongase, the Δ5-elongases encoded by the nucleic acid sequences converting $C_{20}$-fatty acids having at least four double bonds in the fatty acid molecule; which are advantageously ultimately incorporated into diacylglycerides and/or triacylglycerides.

A further subject matter of the invention is thus an isolated nucleic acid sequence which encodes polypeptides with Δ5-elongase and which has the sequence shown in SEQ ID NO: 197.

A further subject matter of the invention is an isolated nucleic acid sequence which encodes polypeptides with Δ6-elongase activity and which has the sequence shown in SEQ ID NO: 199.

Yet a further subject matter of the invention is an isolated nucleic acid sequence which encodes polypeptides with Δ6-desaturase activity and which has the sequence shown in SEQ ID NO: 201.

The subject matters of the invention likewise extend to a recombinant nucleic acid molecule comprising:
a) one or more copies of a promoter which is active in plant cells, preferably in seed cells,
b) at least one nucleic acid sequence with the sequence shown in SEQ ID NO: 193 or SEQ ID NO: 201 which encodes a Δ6-desaturase activity,
c) at least one nucleic acid sequence with the sequence shown in SEQ ID NO: 11 which encodes a Δ5-desaturase activity,
d) at least one nucleic acid sequence with the sequence shown in SEQ ID NO: 27 or SEQ ID NO: 199 which encodes a Δ6-elongase activity, and
e) one or more copies of a terminator sequence.

Advantageously, an additional nucleic acid sequence with the sequence shown in SEQ ID NO: 195 and which encodes a Δ12-desaturase may also advantageously be present in the recombinant abovementioned nucleic acid molecule.

In a further advantageous embodiment, an additional nucleic acid sequence with the sequence shown in SEQ ID NO: 197 and which encodes a Δ5-elongase may also be present in the recombinant nucleic acid molecule.

Besides these abovementioned sequences, further biosynthetic genes of the fatty acid or lipid metabolism selected from the group consisting of acyl-CoA dehydrogenase(s), acyl-ACP [=acyl carrier protein] desaturase(s), acyl-ACP thioesterase(s), fatty acid acyltransferase(s), acyl-CoA:lysophospholipid acyltransferase(s), fatty acid synthase(s), fatty acid hydroxylase(s), acetyl-coenzyme A carboxylase(s), acyl-coenzyme A oxidase(s), fatty acid desaturase(s), fatty acid acetylenases, lipoxygenases, triacylglycerol lipases, allenoxide synthases, hydroperoxide lyases or fatty acid elongase(s) may also be introduced into the recombinant nucleic acid molecule.

These genes are by preference genes of the fatty acid or lipid metabolism selected from the group consisting of Δ4-desaturase, Δ8-desaturase, Δ9-desaturase or Δ9-elongase.

Yet a further subject matter of the invention are gene constructs which comprise the nucleic acid sequences SEQ ID NO: 11, SEQ ID NO: 27, SEQ ID NO: 193, SEQ ID NO: 195, SEQ ID NO: 197, SEQ ID NO: 199 or SEQ ID NO: 201 according to the invention, the nucleic acid being functionally linked to one or more regulatory signals.

All of the nucleic acid sequences used in the process according to the invention are advantageously derived from a eukaryotic organism such as a plant, a microorganism such as an alga or an animal. By preference, the nucleic acid sequences are derived from the order Salmoniformes, *Xenopus* or *Ciona*, algae such as *Mantoniella, Crypthecodinium, Euglena* or *Ostreococcus*, fungi such as the genus *Phytophtora* or from diatoms such as the genera *Thalassiosira* or *Phaeodactylum*.

The nucleic acid sequences used in the process which encode proteins with ω3-desaturase, Δ4-desaturase, Δ5-desaturase, Δ6-desaturase, Δ8-desaturase, Δ9-desaturase, Δ12-desaturase, Δ5-elongase, Δ6-elongase or Δ9-elongase activity are advantageously introduced by themselves or by preference in combination with an expression cassette (=nucleic acid construct) which the expression of the nucleic acids in a plant. More than one nucleic acid sequence of an enzymatic activity such as, for example, a Δ12-desaturase, Δ4-desaturase, Δ5-desaturase, Δ6-desaturase, Δ5-elongase, Δ6-elongase and/or ω3-desaturase may be present in the nucleic acid construct.

For introduction into the plant, the nucleic acids used in the process are advantageously subjected to amplification and ligation in the known manner as described above.

A series of mechanisms exist which enable a modification of the Δ12-desaturase, Δ5-elongase, Δ6-elongase, Δ5-desaturase, Δ4-desaturase, Δ6-desaturase and/or ω3-desaturase protein according to the invention and of the further proteins used in the process, such as the Δ12-desaturase, Δ9-elongase, Δ6-desaturase, Δ8-desaturase, Δ6-elongase, Δ5-desaturase or Δ4-desaturase proteins, so that the yield, production and/or production efficiency of the advantageously polyunsaturated fatty acids in a plant, preferably in an oil crop plant, can be influenced directly as the result of this modified protein. The number or activity of the Δ12-desaturase, ω3-desaturase, Δ9-elongase, Δ6-desaturase, Δ8-desaturase, Δ6-elongase, Δ5-desaturase, Δ5-elongase or Δ4-desaturase proteins or genes can be increased so that larger amounts of the gene products and thus ultimately larger amounts of the compounds of the general formula I are produced. A de-novo synthesis in a plant which had lacked the activity and ability to biosynthesize the compounds prior to the introduction of the gene(s) in question is also possible. The same also applies analogously to the combination with further desaturases or elongases or further enzymes from the fatty acid and lipid metabolism. Also, the use of different, divergent sequences, i.e. sequences which differ at the DNA sequence level, may be advantageous, or the use of promoters for gene expression which makes possible a different temporal gene expression, for example depending on the degree of maturity of a seed or oil-storing tissue.

By introducing a Δ12-desaturase, ω3-desaturase, Δ9-elongase, Δ6-desaturase, Δ8-desaturase, Δ6-elongase, Δ5-desaturase, Δ5-elongase and/or Δ4-desaturase gene into a plant alone or in combination with other genes into a cell may not only increase the biosynthetic flux towards the end product, but also increase the corresponding triacylglycerol composition or create it de novo. Likewise, the number or activity of other genes in the import of nutrients required for the biosynthesis of one or more fatty acids, oils, polar and/or neutral lipids may be increased, so that the concentration of these precursors, cofactors or intermediates within the cells or within the storage compartment is increased, whereby the ability of the cells to produce PUFAs is increased further, as described hereinbelow. By optimizing the activity or increasing the number of one or more Δ12-desaturase, ω3-desaturase, Δ9-elongase, Δ6-desaturase, Δ8-desaturase, Δ6-elongase, Δ5-desaturase, Δ5-elongase or Δ4-desaturase genes which are involved in the biosynthesis of these compounds, or by destroying the activity of one or more genes which are involving in breaking down these compounds, it may be possible to increase the yield, production and/or production efficiency of fatty acid and lipid molecules from organisms and advantageously from plants.

The isolated nucleic acid molecules used in the process according to the invention encode proteins or parts of these, the proteins or the individual protein or parts thereof comprising an amino acid sequence with sufficient homology with an amino acid sequence which is shown in the sequences SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: SEQ ID NO: 44, SEQ ID NO: 46, SEQ ID NO: 48, SEQ ID NO: 50, SEQ ID NO: 52, SEQ ID NO: 54, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 112, SEQ ID NO: 114, SEQ ID NO: 118, SEQ ID NO: 120, SEQ ID NO: 132, SEQ ID NO: 134, SEQ ID NO: 136, SEQ ID NO: 138, SEQ ID NO: 184, SEQ ID NO: 194, SEQ ID NO: 198, SEQ ID NO: 200 or SEQ ID NO: 202 so that the proteins or parts thereof retain a Δ12-desaturase, ω3-desaturase, Δ9-elongase, Δ6-desaturase, Δ8-desaturase, Δ6-elongase, Δ5-desaturase, Δ5-elongase or Δ4-desaturase activity. The proteins or parts thereof, which is/are encoded by the nucleic acid molecule(s), preferably still retain(s) its/their essential enzymatic activity and the ability of participating in the metabolism of compounds required in the formation of cell membranes or lipid bodies in organisms, advantageously in plants, or in the transport of molecules across these membranes. Advantageously, the proteins encoded by the nucleic acid molecules have at least approximately 50%, preferably at least approximately 60% and more preferably at least approximately 70%, 80% or 90% and most preferably at least approximately 85%, 86%, 87%, 88%, 89%, 90%, 91%, 92%, 93%, 94%, 95%, 96%, 97%, 98%, 99% or more identity with the amino sequences shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: SEQ ID NO: 44, SEQ ID NO: 46, SEQ ID NO: 48, SEQ ID NO: 50, SEQ ID NO: 52, SEQ ID NO: 54, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 112, SEQ ID NO: 114, SEQ ID NO: 118, SEQ ID NO: 120, SEQ ID NO: 132, SEQ ID NO: 134, SEQ ID NO: 136, SEQ ID NO: 138, SEQ ID NO: 184, SEQ ID NO: 194, SEQ ID NO: 198, SEQ ID NO: 200 or SEQ ID NO: 202. For the purposes of the invention, homology or homologous is understood as meaning identity or identical.

The homology was calculated over the entire amino acid or nucleic acid sequence region. A series of programs which are based on the various algorithms are available for comparing different sequences. In this context, the algorithms of Needleman and Wunsch or Smith and Waterman give especially reliable results. To carry out the sequence alignments, the program PileUp (J. Mol. Evolution., 25, 351-360, 1987, Higgins et al., CABIOS, 5 1989: 151-153) or the programs Gap and BestFit [Needleman and Wunsch (J. Mol. Biol. 48; 443-453 (1970) and Smith and Waterman (Adv. Appl. Math. 2; 482-489 (1981)], which are part of the GCG software packet [Genetics Computer Group, 575 Science Drive, Madison Wis., USA 53711 (1991)], were used. The sequence homology values stated above as percentages were determined over the entire sequence region using the program GAP, with the following settings: Gap Weight: 50, Length Weight: 3, Average Match: 10.000 and Average Mismatch: 0.000. Unless otherwise specified, these settings were always used as standard settings for sequence alignments.

Essential enzymatic activity of the Δ12-desaturase, ω3-desaturase, Δ9-elongase, Δ6-desaturase, Δ8-desaturase, Δ6-elongase, Δ5-desaturase, Δ5-elongase or Δ4-desaturase used in the process according to the invention is understood as meaning that, in comparison with the proteins/enzymes encoded by the sequence SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 111, SEQ ID NO: 113, SEQ ID NO: 117, SEQ ID NO: 119, SEQ ID NO: 131, SEQ ID NO: 133, SEQ ID NO: 135, SEQ ID NO: 137, SEQ ID NO: 183, SEQ ID NO: 193, SEQ ID NO: 197, SEQ ID NO: 199 or SEQ ID NO: 201 and their derivatives retain at least an enzymatic activity of at least 10%, preferably 20%, especially preferably 30% and very especially 40% and can thus participate in the metabolism of compounds required in the synthesis of fatty acids, fatty acid esters such as diacylglycerides and/or triacylglycerides in an organism, advantageously a plant or plant cell, or in the transport of molecules across membranes, meaning $C_{18}$-, $C_{20}$- or $C_{22}$-carbon chains in the fatty acid molecule with double bonds at at least two, advantageously three, four, five or six positions.

The nucleic acids which can be used advantageously in the process are derived from bacteria, fungi, diatoms, animals such as *Caenorhabditis* or *Oncorhynchus* or plants such as algae or mosses, such as the genera *Shewanella, Physcomitrella, Thraustochytrium, Fusarium, Phytophthora, Ceratodon, Mantoniella, Ostreococcus, Isochrysis, Aleurita, Muscarioides, Mortierella, Borago, Phaeodactylum, Cryphthecodinium*, specifically from the genera and species *Oncorhynchus mykiss, Xenopus laevis, Ciona intestinalis, Thalassiosira pseudonona, Mantoniella squamata, Ostreococcus* sp., *Ostreococcus tauri, Euglena gracilis, Physcomitrella patens, Phytophtora infestans, Fusarium graminaeum, Cryptocodinium cohnii, Ceratodon purpureus, Isochrysis galbana, Aleurita farinosa, Thraustochytrium* sp., *Muscarioides viallii, Mortierella alpina, Borago officinalis, Phaeodactylum tricornutum, Caenorhabditis elegans* or especially advantageously from *Oncorhynchus mykiss, Euglena gracilis, Thalassiosira pseudonona* or *Crypthecodinium cohnii*.

As an alternative, it is possible to use, in the process according to the invention, nucleotide sequences which encode a Δ12-desaturase, ω3-desaturase, Δ9-elongase, Δ6-desaturase, Δ8-desaturase, Δ6-elongase, Δ5-desaturase, Δ5-elongase or Δ4-desaturase and which hybridize, advantageously under stringent conditions, with a nucleotide sequence as shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 111, SEQ ID NO: 113, SEQ ID NO: 117, SEQ ID NO: 119, SEQ ID NO: 131, SEQ ID NO: 133, SEQ ID NO: 135, SEQ ID NO: 137, SEQ ID NO: 183, SEQ ID NO: 193, SEQ ID NO: 197, SEQ ID NO: 199 or SEQ ID NO: 201.

The nucleic acid sequences used in the process are advantageously introduced in an expression cassette which enables the expression of the nucleic acids in organisms such as microorganisms or plants.

In this context, the nucleic acid sequences which encode the Δ12-desaturase, ω3-desaturase, Δ9-elongase, Δ6-desaturase, Δ8-desaturase, Δ6-elongase, Δ5-desaturase, Δ5-elongase or Δ4-desaturase are advantageously linked functionally with one or more regulatory signals to increase gene expression. These regulatory sequences should enable the targeted expression of the genes and protein expression. For example, this may mean, depending on the host plant, that the gene is expressed and/or overexpressed only after induction has taken place, or else that it is expressed and/or overexpressed immediately. For example, these regulatory sequences take the form of sequences to which inductors or repressors bind and thus regulate the expression of the nucleic acid. In addition to these new regulatory sequences, or instead of these sequences, the natural regulation of these sequences may still be present before the actual structural genes and, if appropriate, may have been genetically modified in such a way that the natural regulation has been switched off and the expression of the genes enhanced. The expression cassette (=expression construct=gene construct) may, however, also be simpler in construction, that is to say no additional regulatory signals were inserted before the nucleic acid sequence or its derivatives, and the natural promoter together with its regulation was not removed. Instead, the natural regulatory sequence was mutated in such a way that regulation no longer takes place and/or gene expression is enhanced. These modified promoters can be placed before the natural gene in order to increase the activity either in the form of part-sequences (=promoter with parts of the nucleic acid sequences according to the invention) or else alone. Moreover, the gene construct can advantageously also comprise one or more what are known as "enhancer sequences" in functional linkage with the promoter, and these enable an increased expression of the nucleic acid sequence. Also, it is possible to insert additional advantageous sequences at the 3' end of the DNA sequences, such as further regulatory elements or terminators. The Δ12-desaturase, ω3-desaturase, Δ4-desaturase, Δ5-desaturase, Δ6-desaturase, Δ8-desaturase, Δ5-elongase, Δ6-elongase and/or Δ9-elongase genes can be present in the expression cassette (=gene construct) as one or more copies. Advantageously, only in each case one copy of the genes is present in the expression cassette. This gene construct, or the gene constructs, can be expressed together in the host organism. In this context, the gene construct(s) can be inserted in one or more vectors and be present in the cell in free form or else inserted in the genome. It is advantageous for the insertion of further genes in the host genome when the genes to be expressed are present together in one gene construct.

In this context, the regulatory sequences or factors can, as described above, preferably have a positive effect on the gene expression of the genes which have been introduced, thus increasing it. Thus, enhancement of the regulatory elements can advantageously take place at the transcription level by using strong transcription signals such as promoters and/or enhancers. Besides, however, an enhancement of the translation is also possible, for example by improving the stability of the mRNA.

Advantageous regulatory sequences for the new process are present for example in promoters such as the plant promoters CaMV/35S [Franck et al., Cell 21 (1980) 285-294], PRP 1 [Ward et al., Plant Mol. Biol. 22 (1993)], SSU, OCS, lib4, usp, STLS1, B33, nos or in the ubiquitin or phaseolin promoter. Also advantageous in this context are inducible promoters, such as the promoters described in EP-A-0 388 186 (benzylsulfonamide-inducible), Plant J. 2, 1992:397-404 (Gatz et al., tetracyclin-inducible), EP-A-0 335 528 (abscisic-acid-inducible) or WO 93/21334 (ethanol- or cyclohexenol-inducible). Further suitable plant promoters are the promoter of cytosolic FBPase or the ST-LSI promoter from potato (Stockhaus et al., EMBO J. 8, 1989, 2445), the phosphoribosyl-pyrophosphate amidotransferase promoter from *Glycine max* (Genbank accession No. U87999) or the node-specific promoter described in EP-A-0 249 676. Especially advantageous promoters are promoters which enable the expression in tissues which are involved in the biosynthesis of fatty acids. Very especially advantageous are seed-specific promoters such as the USP promoter in accordance with the practice, but also other promoters such as the LeB4, DC3, phaseolin or napin promoters. Further especially advantageous promoters are seed-specific promoters which can be used for monocotyledonous or dicotyledonous plants and which are described in U.S. Pat. No. 5,608,152 (napin promoter from oilseed rape), WO 98/45461 (oleosin promoter from Arobidopsis), U.S. Pat. No. 5,504,200 (phaseolin promoter from *Phaseolus vulgaris*), WO 91/13980 (Bce4 promoter from *Brassica*), by Baeumlein et al., Plant J., 2, 2, 1992:233-239 (LeB4 promoter from a legume), these promoters being suitable for dicots. The following promoters are suitable for example for monocots: Ipt-2 or Ipt-1 promoter from barley (WO 95/15389) and WO 95/23230), hordein promoter from barley and other promoters which are suitable and which are described in WO 99/16890.

In principle, it is possible to use all natural promoters together with their regulatory sequences, such as those mentioned above, for the novel process. Likewise, it is possible and advantageous to use synthetic promoters, either additionally or alone, especially when they mediate a seed-specific expression, such as, for example, as described in WO 99/16890.

To obtain a particularly high PUFA content especially in transgenic plants, the PUFA biosynthesis genes should advantageously be expressed in a seed-specific manner in oilseed crops. To this end, it is possible to use seed-specific promoters or those promoters which are active in the embryo and/or in the endosperm. In principle, seed-specific promoters can be isolated both from dicotyledonous and from monocotyledonous plants. Such advantageous promoters are detailed further above, for example the USP, Vicilin, Napin, Oleosin, Phaseolin, Bce4, LegB4, Lpt2, Ipt1, Amy32b, Amy 6-6, Aleurain or Bce4 promoter.

Moreover, chemically inducible promoters are also advantageously useful in the process according to the invention.

Further advantageous promoters which are advantageously suitable for expression in soybean are the promoters of the β-conglycinin α-subunit, of the β-conglycinin β-subunit, of the Kunitz trypsin inhibitor, of annexin, of glysinin, of albumin 2S, of legumin A1, of legumin A2 and that of BD30.

Especially advantageous promoters are the USP, LegB4, Fad3, SBP, DC-3 or cruciferin820 promoter.

Advantageous regulatory sequences which are used for the expression of the nucleic acid sequences used in the process according to the invention are terminators for the expression advantageously in soybean are Leg2A3', Kti3', Phas3', BD30 3' or AlS3'.

Especially advantageous terminators are the A7T, OCS, LeB3T or cat terminator.

To ensure a stable integration of the biosynthetic genes in the transgenic plant over several generations, each of the nucleic acids used in the process and which encodes Δ12-desaturase, ω3-desaturase, Δ9-elongase, Δ6-desaturase, Δ8-desaturase, Δ6-elongase, Δ5-desaturase, Δ5-elongase and/or Δ4-desaturase should, as described above, be under the control of its own promoter, preferably of a different promoter, since repeating sequence motifs can lead to instability of the T-DNA, or to recombination events. As described above, the gene construct can also comprise further genes which are to be introduced into the plant.

In this context, the regulatory sequences or factors used advantageously for the expression of the nucleic acids used in the process according to the invention can, as described above, preferably have a positive effect on the gene expression of the genes introduced.

These advantageous vectors, preferably expression vectors, comprise the nucleic acids used in the process which encode the Δ12-desaturases, ω3-desaturases, Δ9-elongases, Δ6-desaturases, Δ8-desaturases, Δ6-elongases, Δ5-desaturases, Δ5-elongases or Δ4-desaturases, or a nucleic acid construct which the used nucleic acid alone or in combination with further biosynthesis genes of the fatty acid or lipid metabolism such as the acyl-CoA:lysophospholipid acyltransferases, ω3-desaturases, Δ4-desaturases, Δ5-desaturases, Δ6-desaturases, Δ8-desaturases, Δ9-desaturases, Δ12-desaturases, ω3-desaturases, Δ5-elongases, Δ6-elongases and/or Δ9-elongases.

As described and used in the present context, the term "vector" refers to a nucleic acid molecule which is capable of transporting another nucleic acid to which it is bound.

The recombinant expression vectors used can be designed for expressing Δ12-desaturases, ω3-desaturases, Δ9-elongases, Δ6-desaturases, Δ8-desaturases, Δ6-elongases, Δ5-desaturases, Δ5-elongases and/or Δ4-desaturases in prokaryotic or eukaryotic cells. This is advantageous since, for the sake of simplicity, intermediate steps of the vector construction are frequently carried out in microorganisms. For example, the Δ12-desaturase, ω3-desaturase, Δ9-elongase, Δ6-desaturase, Δ8-desaturase, Δ6-elongase, Δ5-desaturase, Δ5-elongase and/or Δ4-desaturase genes can be expressed in bacterial cells, insect cells (using baculovirus expression vectors), yeast cells and other fungal cells (see Romanos, M. A., et al. (1992) "Foreign gene expression in yeast: a review", Yeast 8:423-488; van den Hondel, C. A. M. J. J., et al. (1991) "Heterologous gene expression in filamentous fungi", in: More Gene Manipulations in Fungi, J. W. Bennet & L. L. Lasure, Ed., pp. 396-428: Academic Press: San Diego; and van den Hondel, C. A. M. J. J., & Punt, P. J. (1991) "Gene transfer systems and vector development for filamentous fungi, in: Applied Molecular Genetics of Fungi, Peberdy, J. F., et al., Ed., pp. 1-28, Cambridge University Press: Cambridge), algae (Falciatore et al., 1999, Marine Biotechnology. 1, 3:239-251), ciliates of the types: *Holotrichia, Peritrichia, Spirotrichia, Suctoria, Tetrahymena, Paramecium, Colpidium, Glaucoma, Platyophrya, Potomacus, Desaturaseudocohnilembus, Euplotes, Engelmaniella* and *Stylonychia*, in particular the genus *Stylonychia lemnae*, using vectors following a transformation process as described in WO 98/01572, and preferably in cells of multi-celled plants (see Schmidt, R. and Willmitzer, L. (1988) "High efficiency *Agrobacterium tumefaciens*-mediated transformation of *Arabidopsis thaliana* leaf and cotyledon explants" Plant Cell Rep.: 583-586; Plant Molecular Biology and Biotechnology, C Press, Boca Raton, Fla., chapter 6/7, pp. 71-119 (1993); F. F. White, B. Jenes et al., Techniques for Gene Transfer, in: Transgenic Plants, Vol. 1, Engineering and Utilization, Ed.: Kung and R. Wu, Academic Press (1993), 128-43; Potrykus, Annu. Rev. Plant Physiol. Plant Molec. Biol. 42 (1991), 205-225 (and references cited therein)). Suitable host cells are furthermore discussed in Goeddel, Gene Expression Technology: Methods in Enzymology 185, Academic Press, San Diego, Calif. (1990). As an alternative, the recombinant expression vector can be transcribed and translated in vitro, for example using T7-promoter regulatory sequences and T7-polymerase.

In most cases, the expression of proteins in prokaryotes, advantageously for the simple detection of the enzyme activity for example for detecting the desaturase or elongase activity, is performed using vectors comprising constitutive or inducible promoters which control the expression of fusion or nonfusion proteins. Examples of typical fusion expression vectors are pGEX (Pharmacia Biotech Inc; Smith, D. B., and Johnson, K. S. (1988) Gene 67:31-40), pMAL (New England Labs, Beverly, Mass.) and pRIT5 (Pharmacia, Piscataway, N.J.), where glutathione S-transferase (GST), maltose-E-binding protein and protein A, respectively, are fused with the recombinant target protein.

Examples of suitable inducible nonfusion *E. coli* expression vectors are, inter alia, pTrc (Amann et al. (1988) Gene 69:301-315) and pET 11d (Studier et al., Gene Expression Technology: Methods in Enzymology 185, Academic Press, San Diego, Calif. (1990) 60-89). The target gene expression of the pTrc vector is based on the transcription from a hybrid trp-lac fusion promoter by host RNA polymerase. The target gene expression from the pET 11d vector is based on the transcription of a T7-gn10-lac fusion promoter, which is mediated by a coexpressed viral RNA polymerase (T7 gn1). This viral polymerase is provided by the host strains BL21 (DE3) or HMS174 (DE3) from a resident λ-prophage which harbors a T7 gn1 gene under the transcriptional control of the lacUV 5 promoter.

The skilled worker is familiar with other vectors which are suitable in prokaryotic organisms, these vectors are, for example *E. coli*, pLG338, pACYC184, the pBR series such as pBR322, the pUC series such as pUC18 or pUC19, the M113mp series, pKC30, pRep4, pHS1, pHS2, pPLc236, pMBL24, pLG200, pUR290, pIN-III113-B1, λgt11 or pBdCI, in *Streptomyces* pIJ101, pIJ364, pIJ702 or pIJ361, in *Bacillus* pUB110, pC194 or pBD214, in *Corynebacterium* pSA77 or pAJ667.

In a further embodiment, the expression vector is a yeast expression vector. Examples of vectors for expression in the yeast *S. cerevisiae* comprise pYeDesaturasec1 (Baldari et al. (1987) Embo J. 6:229-234), pMFa (Kurjan and Herskowitz (1982) Cell 30:933-943), pJRY88 (Schultz et al. (1987) Gene 54:113-123) and pYES2 (Invitrogen Corporation, San Diego, Calif.). Vectors and processes for the construction of vectors which are suitable for use in other fungi, such as the filamentous fungi, comprise those which are described in detail in: van den Hondel, C. A. M. J. J., & Punt, P. J. (1991) "Gene transfer systems and vector development for filamentous fungi, in: Applied Molecular Genetics of fungi, J. F. Peberdy et al., Ed. pp. 1-28, Cambridge University Press: Cambridge, or in: More Gene Manipulations in Fungi [J. W. Bennett & L. L. Lasure, Ed., pp. 396-428: Academic Press: San Diego]. Further suitable yeast vectors are, for example, pAG-1, YEp6, YEp13 or pEMBLYe23.

As an alternative, the Δ12-desaturases, ω3-desaturases, Δ9-elongases, Δ6-desaturases, Δ8-desaturases, Δ6-elongases, Δ5-desaturases, Δ5-elongases and/or Δ4-desaturases can be expressed in insect cells using baculovirus expression vectors. Baculovirus vectors which are available for the expression of proteins in cultured insect cells (for example Sf9 cells) comprise the pAc series (Smith et al. (1983) Mol. Cell Biol. 3:2156-2165) and the pVL series (Lucklow and Summers (1989) Virology 170:31-39).

The abovementioned vectors are only a small overview of possible suitable vectors. Further plasmids are known to the skilled worker and are described, for example, in: Cloning Vectors (Ed., Pouwels, P. H., et al., Elsevier, Amsterdam-New York-Oxford, 1985, ISBN 0 444 904018). Further suitable expression systems for prokaryotic and eukaryotic cells, see the chapters 16 and 17 of Sambrook, J., Fritsch, E. F., and Maniatis, T., Molecular Cloning: A Laboratory Manual, $2^{nd}$ edition, Cold Spring Harbor Laboratory, Cold Spring Harbor Laboratory Press, Cold Spring Harbor, N.Y., 1989.

To detect the enzyme activity, Δ12-desaturases, ω3-desaturases, Δ9-elongases, Δ6-desaturases, Δ8-desaturases, Δ6-elongases, Δ5-desaturases, Δ5-elongases and/or Δ4-desaturases can be expressed in single-cell plant cells (such as algae), see Falciatore et al., 1999, Marine Biotechnology 1 (3):239-251 and the references cited therein, and plant cells from higher plants (for example Spermatophytes, such as arable crops). Examples of plant expression vectors comprise those which are described in detail in: Becker, D., Kemper, E., Schell, J., and Masterson, R. (1992) "New plant binary vectors with selectable markers located proximal to the left border", Plant Mol. Biol. 20:1195-1197; and Bevan, M. W. (1984) "Binary *Agrobacterium* vectors for plant transformation", Nucl. Acids Res. 12:8711-8721; Vectors for Gene Transfer in Higher Plants; in: Transgenic Plants, Vol. 1, Engineering and Utilization, Ed.: Kung and R. Wu, Academic Press, 1993, p. 15-38.

A plant expression cassette preferably comprises regulatory sequences which are capable of controlling the gene expression in plant cells and which are functionally linked so that each sequence can fulfill its function, such as transcriptional termination, for example polyadenylation signals. Preferred polyadenylation signals are those which are derived from *Agrobacterium tumefaciens* T-DNA, such as the gene 3 of the Ti plasmid pTiACH5, which is known as octopine synthase (Gielen et al., EMBO J. 3 (1984) 835 et seq.) or functional equivalents of these, but all other terminators which are functionally active in plants are also suitable.

Since plant gene expression is very often not limited to transcriptional levels, a plant expression cassette preferably comprises other functionally linked sequences such as translation enhancers, for example the overdrive sequence, which comprises the 5'-untranslated tobacco mosaic virus leader sequence, which increases the protein/RNA ratio (Gallie et al., 1987, Nucl. Acids Research 15:8693-8711).

As described above, plant gene expression must be functionally linked to a suitable promoter which performs the expression of the gene in a timely, cell-specific or tissue-specific manner. Promoters which can be used are constitutive promoters (Benfey et al., EMBO J. 8 (1989) 2195-2202) such as those which are derived from plant viruses such as 35S CAMV (Franck et al., Cell 21 (1980) 285-294), 19S CaMV (see also U.S. Pat. No. 5,352,605 and WO 84/02913) or plant promoters such as the promoter of the Rubisco small subunit, which is described in U.S. Pat. No. 4,962,028.

Other preferred sequences for the use in functional linkage in plant gene expression cassettes are targeting sequences which are required for targeting the gene product into its relevant cell compartment (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, oil bodies, peroxisomes and other compartments of plant cells.

As described above, plant gene expression can also be facilitated via a chemically inducible promoter (for a review, see Gatz 1997, Annu. Rev. Plant Physiol. Plant Mol. Biol., 48:89-108). Chemically inducible promoters are particularly suitable if it is desired that genes are expressed in a time-specific manner. Examples of such promoters are a salicylic-acid-inducible promoter (WO 95/19443), a tetracyclin-inducible promoter (Gatz et al. (1992) Plant J. 2, 397-404) and an ethanol-inducible promoter.

Promoters which respond to biotic or abiotic stress conditions are also suitable promoters, for example the pathogen-inducible PRP1-gene promoter (Ward et al., Plant Mol. Biol. 22 (1993) 361-366), the heat-inducible hsp80 promoter from tomato (U.S. Pat. No. 5,187,267), the cold-inducible alpha-amylase promoter from potato (WO 96/12814) or the wound-inducible pinII promoter (EP-A-0 375 091).

The promoters which are especially preferred are those which bring about the expression of genes in tissues and organs in which fatty acid, lipid and oil biosynthesis takes place, in seed cells such as the cells of endosperm and of the developing embryo. Suitable promoters are the napin gene promoters from oilseed rape (U.S. Pat. No. 5,608,152), the USP promoter from *Vicia faba* (Baeumlein et al., Mol. Gen. Genet, 1991, 225 (3):459-67), the oleosin promoter from *Arabidopsis* (WO 98/45461), the phaseolin promoter from *Phaseolus vulgaris* (U.S. Pat. No. 5,504,200), the Bce4 promoter from *Brassica* (WO 91/13980) or the legumin B4 promoter (LeB4; Baeumlein et al., 1992, Plant Journal, 2 (2):233-9), and promoters which bring about the seed-specific expression in monocotyledonous plants such as maize, barley, wheat, rye, rice and the like. Suitable promoters to be taken into consideration are the Ipt2 or Ipt1 gene promoter from barley (WO 95/15389 and WO 95/23230) or those which are described in WO 99/16890 (promoters from the barley hordein gene, the rice glutelin gene, the rice oryzin gene, the rice prolamin gene, the wheat gliadin gene, wheat glutelin gene, the maize zein gene, the oat glutelin gene, the *sorghum kasirin* gene, the rye secalin gene).

In particular, the multiparallel expression of the Δ12-desaturases, ω3-desaturases, Δ9-elongases, Δ6-desaturases, Δ8-desaturases, Δ6-elongases, Δ5-desaturases, Δ5-elongases and/or Δ4-desaturases may be desired. Such expression cassettes can be introduced via a simultaneous transformation of a plurality of individual expression constructs or, preferably, by combining a plurality of expression cassettes on one construct. Also, it is possible to transform a plurality of vectors with in each case a plurality of expression cassettes and to transfer them to the host cell.

Likewise especially suitable are promoters which bring about the plastid-specific expression since plastids are the compartment in which the precursors and some end products of lipid biosynthesis are synthetized. Suitable promoters such as the viral RNA-polymerase promoter, are described in WO 95/16783 and WO 97/06250, and the clpP promoter from *Arabidopsis*, described in WO 99/46394.

Vector DNA can be introduced into prokaryotic or eukaryotic cells via conventional transformation or transfection techniques. The terms "transformation" and "transfection", conjugation and transduction, as used in the present context, are intended to comprise a multiplicity of prior-art processes for introducing foreign nucleic acid (for example DNA) into a host cell, including calcium phosphate or calcium chloride coprecipitation, DEAE-dextran-mediated transfection, lipofection, natural competence, chemically mediated transfer, electroporation or particle bombardment. Suitable methods for the transformation or transfection of host cells, including plant cells, can be found in Sambrook et al. (Molecular Cloning: A Laboratory Manual, $2^{nd}$ ed., Cold Spring Harbor Laboratory, Cold Spring Harbor Laboratory Press, Cold Spring Harbor, N.Y., 1989) and other laboratory manuals, such as Methods in Molecular Biology, 1995, Vol. 44, *Agrobacterium* protocols, Ed.: Gartland and Davey, Humana Press, Totowa, N.J.

The host organisms which are advantageously used are plant cells, preferably plants or parts thereof. Especially preferred plants are plants such as oilseed plants or oil crops, which comprise large amounts of lipid compounds, such as oilseed rape, evening primrose, hemp, thistle, peanut, canola, linseed, soybean, safflower, Indian mustard, sunflower, borage or plants such as maize, wheat, rye, oats, triticale, rice, barley, cotton, cassava, pepper, *Tagetes*, Solanaceae plants such as potato, tobacco, eggplant and tomato, *Vicia* species, pea, alfalfa, bushy plants (coffee, cacao, tea), *Salix* species, trees (oil palm, coconut) and perennial grasses and fodder crops. Especially preferred plants according to the invention are oil crops such as soybean, peanut, oilseed rape, canola, linseed, hemp, evening primrose, sunflower, safflower, trees (oil palm, coconut).

As described above, a further subject matter according to the invention is an isolated nucleic acid sequence which encodes polypeptides with Δ5-elongase activity and which has the sequence shown in SEQ ID NO: 197, where the elongase encoded by the nucleic acid sequence does not elongate $C_{16}$- and $C_{18}$-fatty acids with one double bond. Polyunsaturated $C_{18}$-fatty acids with one Δ6-double bond, or $C_{22}$-fatty acids, are not converted either. Advantageously, only polyunsaturated $C_{20}$-fatty acids with one Δ5-double bond are elongated by the enzymatic activity. Further subject matters of the invention are, as described above, a Δ6-elongase, Δ6-desaturase and a Δ12-desaturase.

In an advantageous embodiment, the term "nucleic acid (molecule)" as used in the present text additionally comprises the untranslated sequence at the 3' and at the 5' terminus of the coding gene region: at least 500, preferably 200, especially preferably 100 nucleotides of the sequence upstream of the 5' terminus of the coding region and at least 100, preferably 50, especially preferably 20 nucleotides of the sequence downstream of the 3' terminus of the coding gene region. An "isolated" nucleic acid molecule is separated from other nucleic acid molecules which are present in the natural source of the nucleic acid. An "isolated" nucleic acid preferably has no sequences which naturally flank the nucleic acid in the genomic DNA of the organism from which the nucleic acid is derived (for example sequences which are located at the 5' and 3' termini of the nucleic acid). In various embodiments, the isolated Δ12-desaturase, ω3-desaturase, Δ9-elongase, Δ6-desaturase, Δ8-desaturase, Δ6-elongase, Δ5-desaturase, Δ5-elongase or Δ4-desaturase molecule can, for example, comprise less than approximately 5 kb, 4 kb, 3 kb, 2 kb, 1 kb, 0.5 kb or 0.1 kb of nucleotide sequences which naturally flank the nucleic acid molecule in the genomic DNA of the cell from which the nucleic acid is derived.

The nucleic acid molecules used in the process, for example a nucleic acid molecule with a nucleotide sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 111, SEQ ID NO: 113, SEQ ID NO: 117, SEQ ID NO: 119, SEQ ID NO: 131, SEQ ID NO: 133, SEQ ID NO: 135, SEQ ID NO: 137, SEQ ID NO: 183, SEQ ID NO: 193, SEQ ID NO: 197, SEQ ID NO: 199 or SEQ ID NO: 201 or part thereof, can be isolated using standard techniques of molecular biology and the sequence information provided herein. Also, for example a homologous sequence or homologous, conserved sequence regions at the DNA or amino acid level can be identified with the aid of comparative algorithms. These sequence regions can be used as hybridization probe and standard hybridization techniques (such as, for example, described in Sambrook et al., Molecular Cloning: A Laboratory Manual, $2^{nd}$ ed., Cold Spring Harbor Laboratory, Cold Spring Harbor Laboratory Press, Cold Spring Harbor, N.Y., 1989) for isolating further nucleic acid sequences which are useful in the process. Moreover, a nucleic acid molecule comprising a complete sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 111, SEQ ID NO: 113, SEQ ID NO: 117, SEQ ID NO: 119, SEQ ID NO: 131, SEQ ID NO: 133, SEQ ID NO: 135, SEQ ID NO: 137, SEQ ID NO: 183, SEQ ID NO: 193, SEQ ID NO: 197, SEQ ID NO: 199 or SEQ ID NO: 201 or part thereof can be isolated by polymerase chain reaction, where oligonucleotide primers which on the basis of this sequence or parts thereof are used (for example, a nucleic acid molecule comprising the complete sequence or part thereof can be isolated by polymerase chain reaction using oligonucleotide primers which have been generated on the basis of this very sequence). For example, mRNA can be isolated from cells (for example by the guanidinium thiocyanate extraction process by Chirgwin et al. (1979) Biochemistry 18:5294-5299) and cDNA can be generated by means of reverse transcriptase (for example Moloney-MLV reverse transcriptase, from Gibco/BRL, Bethesda, Md., or AMV reverse transcriptase, from Seikagaku America, Inc., St. Petersburg, Fla.). Synthetic oligonucleotide primers for the amplification by means of polymerase chain reaction can be generated on the basis of one of the sequences shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 69, SEQ ID NO:

71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 111, SEQ ID NO: 113, SEQ ID NO: 117, SEQ ID NO: 119, SEQ ID NO: 131, SEQ ID NO: 133, SEQ ID NO: 135, SEQ ID NO: 137, SEQ ID NO: 183, SEQ ID NO: 193, SEQ ID NO: 197, SEQ ID NO: 199 or SEQ ID NO: 201 or with the aid of the amino acid sequences shown in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: SEQ ID NO: 44, SEQ ID NO: 46, SEQ ID NO: 48, SEQ ID NO: 50, SEQ ID NO: 52, SEQ ID NO: 54, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 112, SEQ ID NO: 114, SEQ ID NO: 118, SEQ ID NO: 120, SEQ ID NO: 132, SEQ ID NO: 134, SEQ ID NO: 136, SEQ ID NO: 138, SEQ ID NO: 184, SEQ ID NO: 194, SEQ ID NO: 198, SEQ ID NO: 200 or SEQ ID NO: 202. One of the abovementioned nucleic acids can be amplified in accordance with standard PCR amplification techniques using cDNA or, alternatively, genomic DNA as template and suitable oligonucleotide primers. The nucleic acid amplified thus can be cloned into a suitable vector and characterized by means of DNA sequence analysis. Oligonucleotides which correspond to a desaturase nucleotide sequence can be generated by synthetic standard methods, for example using an automatic DNA synthesizer.

Homologs of the Δ12-desaturase, ω3-desaturase, Δ9-elongase, Δ6-desaturase, Δ8-desaturase, Δ6-elongase, Δ5-desaturase, Δ5-elongase or Δ4-desaturase nucleic acid sequences used, with the sequence SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 111, SEQ ID NO: 113, SEQ ID NO: 117, SEQ ID NO: 119, SEQ ID NO: 131, SEQ ID NO: 133, SEQ ID NO: 135, SEQ ID NO: 137, SEQ ID NO: 183, SEQ ID NO: 193, SEQ ID NO: 197, SEQ ID NO: 199 or SEQ ID NO: 201, mean for example allelic variants with at least approximately 50 or 60%, preferably at least approximately 60 or 70%, more preferably at least approximately 70 or 80%, 90% or 95% and even more preferably at least approximately 85%, 86%, 87%, 88%, 89%, 90%, 91%, 92%, 93%, 94%, 95%, 96%, 97%, 98%, 99% or more identity or homology with one of the nucleotide sequences shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 111, SEQ ID NO: 113, SEQ ID NO: 117, SEQ ID NO: 119, SEQ ID NO: 131, SEQ ID NO: 133, SEQ ID NO: 135, SEQ ID NO: 137, SEQ ID NO: 183, SEQ ID NO: 193, SEQ ID NO: 197, SEQ ID NO: 199 or SEQ ID NO: 201 or their homologs, derivatives or analogs or parts thereof. Furthermore, isolated nucleic acid molecules of a nucleotide sequence which hybridize, for example under stringent conditions, with one of the nucleotide sequences shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 111, SEQ ID NO: 113, SEQ ID NO: 117, SEQ ID NO: 119, SEQ ID NO: 131, SEQ ID NO: 133, SEQ ID NO: 135, SEQ ID NO: 137, SEQ ID NO: 183, SEQ ID NO: 193, SEQ ID NO: 197, SEQ ID NO: 199 or SEQ ID NO: 201 or a part thereof. A part in accordance with the invention is understood as meaning, in this context, that at least 25 base pairs (=bp), 50 bp, 75 bp, 100 bp, 125 bp or 150 bp, preferably at least 175 bp, 200 bp, 225 bp, 250 bp, 275 bp or 300 bp, especially preferably 350 bp, 400 bp, 450 bp, 500 bp or more base pairs are used for the hybridization. Advantageously, the entire sequence may also be used. Allelic variants comprise in particular functional variants which can be obtained by deletion, insertion or substitution of nucleotides from/into the sequence shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 111, SEQ ID NO: 113, SEQ ID NO: 117, SEQ ID NO: 119, SEQ ID NO: 131, SEQ ID NO: 133, SEQ ID NO: 135, SEQ ID NO: 137, SEQ ID NO: 183, SEQ ID NO: 193, SEQ ID NO: 197, SEQ ID NO: 199 or SEQ ID NO: 201, the intention being, however, that the enzyme activity of the resulting protein synthesized advantageously being retained for the insertion of one or more genes. Proteins which still retain the enzymatic activity of Δ12-desaturase, ω3-desaturase, Δ9-elongase, Δ6-desaturase, Δ8-desaturase, Δ6-elongase, Δ5-desaturase, Δ5-elongase or Δ4-desaturase, i.e. whose activity is essentially not reduced, mean proteins with at least 10%, preferably 20%, especially preferably 30%, very especially preferably 40% of the original enzyme activity in comparison with the protein encoded by SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 111, SEQ ID NO: 113, SEQ ID NO: 117, SEQ ID NO: 119, SEQ ID NO: 131, SEQ ID NO: 133, SEQ ID NO: 135, SEQ ID NO: 137, SEQ ID NO: 183, SEQ ID NO: 193, SEQ ID NO: 197, SEQ ID NO: 199 or SEQ ID NO: 201. The homology was calculated over the entire amino acid or nucleic acid sequence region. A series of programs based on a variety of algorithms is available to the skilled worker for comparing different sequences. In this context, the algorithms of Needleman and Wunsch or Smith and Waterman give particularly reliable results. To carry out the sequence alignments, the program PileUp (J. Mol. Evolution., 25, 351-360, 1987, Higgins et al., CABIOS, 5 (1989: 151-153) or the programs Gap and BestFit [Needleman and Wunsch (J. Mol. Biol. 48; 443-453 (1970) and Smith and Waterman (Adv. Appl. Math. 2; 482-489 (1981)], which are part of the GCG software packet [Genetics Computer Group, 575 Science Drive, Madison Wis., USA 53711 (1991)], were used. The sequence homology values detailed above in percent were determined using the program GAP over the entire sequence region with the following settings: Gap Weight: 50, Length Weight: 3, Average Match: 10.000 and Average Mismatch: 0.000, which, unless otherwise specified, were always used as standard settings for sequence alignments.

Homologs of the abovementioned nucleic acid sequences also mean for example bacterial, fungal and plant homologs, truncated sequences, single-stranded DNA or RNA of the coding and noncoding DNA sequence or else derivatives such as, for example, promoter variants. The promoters upstream of the nucleotide sequences stated can be modified by one or more nucleotide substitutions, by insertion(s) and/or deletion(s), without, however, the functionality or activity of the promoters being adversely affected. Furthermore, it is possible that the activity of the promoters is increased by modifying their sequence, or that they are replaced completely by more active promoters, including those from heterologous organisms.

The abovementioned nucleic acids and protein molecules with Δ12-desaturase, ω3-desaturase, Δ9-elongase, Δ6-desaturase, Δ8-desaturase, Δ6-elongase, Δ5-desaturase, Δ5-elongase and/or Δ4-desaturase activity which are involved in the metabolism of lipids and fatty acids, PUFA cofactors and enzymes or in the transport of lipophilic compounds across membranes are used in the process according to the invention for modulating the production of PUFAs in transgenic plants such as maize, wheat, rye, oats, triticale, rice, barley, soybean, peanut, cotton, *Linum* species such as linseed or flax, *Brassica* species such as oilseed rape, canola, Indian mustard and turnip rape, pepper, sunflower, borage, evening primrose and *Tagetes*, Solanaceae plants such as potato, tobacco, eggplant or tomato, *Vicia* species, pea, cassava, alfalfa, bushy plants (coffee, cacao, tea), *Salix* species, trees (oil palm, coconut) and perennial grasses and fodder crops either directly (for example when the overexpression or optimization of a fatty acid biosynthetic protein has a direct effect on the yield, production and/or production efficiency of the fatty acid from modified organisms) and/or can have an indirect effect which nevertheless entails an increase in the yield, production and/or production efficiency of the PUFAs or a decrease of undesired compounds (for example when the modulation of the metabolism of lipids and fatty acids, cofactors and enzymes results in changes in the yield, production and/or production efficiency or the composition of the desired compounds within the cells which, in turn, can have an effect on the production of one or more fatty acids).

Brassicaceae, Boraginaceae, Primulaceae or Linaceae are especially suitable for the production of PUFAs, preferably of arachidonic acid, eicosapentaenoic acid or docosahexaenoic acid. Especially suitable for the production of PUFAs with the nucleic acid sequences according to the invention, advantageously, as described, in combination with further desaturases and elongases are Indian mustard (*Brassica juncea*), oilseed rape and *Camelina sativa*.

The combination of a variety of precursor molecules and biosynthetic enzymes leads to the production of different fatty acid molecules, which has a major effect on the composition of the lipids since polyunsaturated fatty acids (=PUFAs) are incorporated not only into triacylglycerol but also into membrane lipids.

Brassicaceae, Boraginaceae, Primulaceae or Linaceae are especially suitable for the production of PUFAs, for example stearidonic acid, eicosapentaenoic acid or docosahexaenoic acid. Linseed (*Linum usitatissumum*) and *Brassica juncea* and *Camelina sativa* are especially advantageously suitable for the production of PUFAs with the nucleic acid sequences according to the invention, advantageously, as described, in combination with further desaturates and elongases.

Lipid synthesis can be divided into two sections: the synthesis of fatty acids and their binding to sn-glycerol-3-phosphate, and the addition or modification of a polar head group. Usual lipids which are used in membranes comprise phospholipids, glycolipids, sphingolipids and phosphoglycerides. Fatty acid synthesis starts with the conversion of acetyl-CoA into malonyl-CoA by acetyl-CoA carboxylase or into acetyl-ACP by acetyl transacylase. After condensation reaction, these two product molecules together form acetoacetyl-ACP, which is converted via a series of condensation, reduction and dehydration reactions so that a saturated fatty acid molecule with the desired chain length is obtained. The production of the unsaturated fatty acids from these molecules is catalyzed by specific desaturases, either aerobically by means of molecular oxygen or anaerobically (regarding the fatty acid synthesis in microorganisms, see F. C. Neidhardt et al. (1996) *E. coli* and *Salmonella*. ASM Press: Washington, D.C., p. 612-636 and references cited therein; Lengeler et al. (Ed.) (1999) Biology of Procaryotes. Thieme: Stuttgart, N.Y., and the references therein, and Magnuson, K., et al. (1993) Microbiological Reviews 57:522-542 and the references therein). To undergo the further elongation steps, the resulting phospholipid-bound fatty acids must be returned from the phospholipids to the fatty acid CoA ester pool. This is made possible by acyl-CoA:lysophospholipid acyltransferases. Moreover, these enzymes are capable of transferring the elongated fatty acids from the CoA esters back to the phospholipids. If appropriate, this reaction sequence can be followed repeatedly.

Examples of precursors for PUFA biosynthesis are oleic acid, linoleic acid and linolenic acid. These $C_{18}$-carbon fatty acids must be elongated to $C_{20}$ and $C_{22}$ to obtain fatty acids of the eicosa and docosa chain type. It is possible, with the aid of the desaturases used in the process, such as the Δ12-, ω3-, Δ5-, Δ6- and Δ8-desaturases and/or the Δ5-, Δ9-elongases to produce arachidonic acid, eicosapentaenoic acid, docosapentaenoic acid or docosahexaenoic acid, advantageously eicosapentaenoic acid and/or docosahexaenoic acid, and subsequently to use them for a variety of purposes in applications in the fields of foodstuffs, feedstuffs, cosmetics or pharmaceuticals. Using the abovementioned enzymes, $C_{20}$- and/or $C_{22}$-fatty acids with at least two, advantageously at least three, four, five or six double bonds in the fatty acid molecule, preferably $C_{20}$- or $C_{22}$-fatty acids with advantageously four, five or six double bonds in the fatty acid molecule can be produced. The desaturation can take place before or after elongation of the fatty acid in question. This is why the products of the desaturase activities and the further possible desaturation and elongation lead to preferred PUFAs with a higher degree of desaturation, including a further elongation of $C_{20}$- to $C_{22}$-fatty acids, to fatty acids such as γ-linolenic acid, dihomo-γ-linolenic acid, arachidonic acid, stearidonic acid, eicosatetraenoic acid or eicosapentaenoic acid. Substrates of the desaturases and elongases used in the process according to the invention are $C_{16}$-, $C_{18}$- or $C_{20}$-fatty acids such as, for example, linoleic acid, γ-linolenic acid, α-linolenic acid, dihomo-γ-linolenic acid, eicosatetraenoic acid or stearidonic acid. Preferred substrates are linoleic acid, γ-linolenic acid and/or α-linolenic acid, dihomo-γ-linolenic acid or arachidonic acid, eicosatetraenoic acid or eicosapentaenoic acid. The synthesized $C_{20}$- to $C_{22}$-fatty acids with at least two, three, four, five or six, advantageously at least four, five or six double bonds in the fatty acid are obtained in the process according to the invention in the form of the free fatty acid or in the form of its esters, for example in the form of its glycerides.

The term "glyceride" is understood as meaning glycerol esterified with one, two or three carboxyl radicals (mono-, di- or triglyceride). "Glyceride" is also understood as meaning a mixture of various glycerides. The glyceride or glyceride mixture can comprise further additions, for example free fatty acids, antioxidants, proteins, carbohydrates, vitamins and/or other substances.

A "glyceride" for the purposes of the process according to the invention is furthermore understood as meaning derivatives which are derived from glycerol. In addition to the above-described fatty acid glycerides, these also include glycerophospholipids and glyceroglycolipids. Preferred examples which may be mentioned here are the glycerophospholipids such as lecithin (phosphatidylcholine), cardiolipin, phosphatidylglycerol, phosphatidylserine and alkylacylglycerophospholipids.

Furthermore, fatty acids must subsequently be transported to various sites of modification and incorporated into the triacylglycerol storage lipid. A further important step in lipid synthesis is the transfer of fatty acids onto the polar head groups, for example by glycerol-fatty-acid acyltransferase (see Frentzen, 1998, Lipid, 100(4-5):161-166).

Publications on plant fatty acid biosynthesis, desaturation, the lipid metabolism and the transmembrane transport of fatty compounds, beta-oxidation, fatty acid modification and cofactors, triacylglycerol storage and assembly, including the references therein, see the following articles: Kinney, 1997, Genetic Engineering, Ed., J K Setlow, 19:149-166; Ohlrogge and Browse, 1995, Plant Cell 7:957-970; Shanklin and Cahoon, 1998, Annu. Rev. Plant Physiol. Plant Mol. Biol. 49:611-641; Voelker, 1996, Genetic Engineering, Ed.: J K Setlow, 18:111-13; Gerhardt, 1992, Prog. Lipid R. 31:397-417; Gühnemann-Schafer & Kindl, 1995, Biochim. Biophys Acta 1256:181-186; Kunau et al., 1995, Prog. Lipid Res. 34:267-342; Stymme et al., 1993, in: Biochemistry and Molecular Biology of Membrane and Storage Lipids of Plants, Ed.: Murata and Somerville, Rockville, American Society of Plant Physiologists, 150-158, Murphy & Ross 1998, Plant Journal. 13(1):1-16.

The PUFAs produced in the process comprise a group of molecules which higher animals are no longer capable of synthesizing and must therefore take up, or which higher animals are no longer capable of synthesizing themselves in sufficient quantity and must therefore take up additionally, although they can be readily synthesized by other organisms such as bacteria; for example, cats are no longer capable of synthesizing arachidonic acid.

Phospholipids are to be understood as meaning, for the purposes of the invention, phosphatidylcholine, phosphatidylethanolamine, phosphatidylserine, phosphatidylglycerol and/or phosphatidylinositol, advantageously phosphatidylcholine.

The terms "production" or "productivity" are known in the art and refer to the concentration of the fermentation product (compounds of the formula I) formed within a certain period of time and a certain fermentation volume (for example kg of product per hour per liter). They also encompass the productivity within a plant cell or a plant, i.e. the content of the desired fatty acids produced in the process based on the content of all fatty acids in this cell or plant. The term production efficiency encompasses the time required for obtaining a certain amount of product (for example the time required by the cell for establishing a certain throughput rate of a fine chemical). The term "yield" or "product/carbon yield" is known in the art and comprises the efficiency of the conversion of the carbon source into the product (i.e. the fine chemical). This is usually expressed for example as kg of product per kg of carbon source. By increasing the yield or production of the compound, the amount of the obtained molecules or of the suitable obtained molecules of this compound in a certain amount of culture is increased over a specified period.

The terms "biosynthesis" or "biosynthetic pathway" are known in the art and comprise the synthesis of a compound, preferably of an organic compound, by a cell starting from intermediates, for example in a multistep process which is highly regulated. The terms "catabolism" or "catabolic pathway" are known in the art and comprise the cleavage of a compound, preferably of an organic compound, by a cell to give catabolytes (in more general terms, smaller or less complex molecules), for example in a multistep process which is highly regulated.

The term "metabolism" is known in the art and encompasses the totality of the biochemical reactions which take place in an organism. Thus, the metabolism of a certain compound (for example the metabolism of a fatty acid) comprises the totality of the biosynthetic, modification and catabolic pathways of this compound in the cell.

This invention is illustrated in greater detail by the examples which follow, which are not to be construed as limiting. The content of all of the references, patent applications, patents and published patent applications cited in the present patent application is herewith incorporated by reference.

EXAMPLES

Example 1: General Cloning Methods

The cloning methods such as, for example, restriction cleavages, agarose gel electrophoresis, purification of DNA fragments, transfer of nucleic acids to nitrocellulose and nylon membranes, linkage of DNA fragments, transformation of *E. coli* cells, bacterial cultures and the sequence analysis of recombinant DNA were carried out as described by Sambrook et al. (1989) (Cold Spring Harbor Laboratory Press: ISBN 0-87969-309-6).

Example 2: Sequence Analysis of Recombinant DNA

Recombinant DNA molecules were sequenced with an ABI laser fluorescence DNA sequencer by the process of Sanger (Sanger et al. (1977) Proc. Natl. Acad. Sci. USA74, 5463-5467). Fragments resulting from a polymerase chain reaction were sequenced and verified to avoid polymerase errors in constructs to be expressed.

Example 3: Cloning Genes from *Oncorhynchus mykiss*

As the result of a search for conserved regions in the protein sequences corresponding to the elongase genes detailed in the application, two sequences with suitable motifs were identified in the Genbank sequence database.

| Name of gene | Genbank No. | Amino acids |
|---|---|---|
| OmELO2 | CA385234, CA364848, CA366480 | 264 |
| OmELO3 | CA360014, CA350786 | 295 |

Total RNA from *Oncorhynchus mykiss* was isolated with the aid of the RNAeasy Kit from Qiagen (Valencia, Calif., US). Poly-A+ RNA (mRNA) was isolated from the total RNA with the aid of oligo-dT cellulose (Sambrook et al., 1989). The RNA was subjected to reverse transcription using the reverse transcription system kit from Promega, and the cDNA synthesized was cloned into the lambda ZAP vector (lambda ZAP Gold, Stratagene). The cDNA was depackaged in accordance with the manufacturer's instructions to give the plasmid DNA. The cDNA plasmid library was then used for the PCR for cloning expression plasmids.

Example 4: Cloning Expression Plasmids for the Heterologous Expression in Yeasts To clone the two sequences for heterologous expression in yeasts, the following oligonucleotides were used for the PCR reaction:

| Primer | Nucleotide sequence |
|---|---|
| 5' f* OmELO2 | 5' aagcttacataatggcttcaacatggcaa (SEQ ID NO: 179) |
| 3' r* OmELO2 | 5' ggatccttatgtcttcttgctcttcctgtt (SEQ ID NO: 180) |
| 5' f OmELO3 | 5' aagcttacataatggagactttaat (SEQ ID NO: 181) |
| 3' r OmELO3 | 5' ggatccttcagtcccccctcactttcc (SEQ ID NO: 182) |

*f: forward, r: reverse

Composition of the PCR Mix (50 µl):
5.00 µl template cDNA
5.00 µl 10× buffer (Advantage polymerase)+25 mM MgCl$_2$
5.00 µl of 2 mM dNTP
1.25 µl of each primer (10 pmol/µl)
0.50 µl of Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated for 2 hours at 37° C. with the restriction enzymes HindIII and BamHI. The yeast expression vector pYES3 (Invitrogen) was incubated in the same manner. Thereafter, the 812 bp PCR product and the 905 bp PCR product and the vector were separated by agarose gel electrophoresis and the corresponding DNA fragments were excised. The DNA was purified by means of the Qiagen Gel Purification Kit following the manufacturer's instructions. Thereafter, the vector and the elongase cDNA were ligated. The Rapid Ligation Kit from Roche was used for this purpose. The resulting plasmids pYES3-OmELO2 and pYES3-OmELO3 were verified by sequencing and transformed into the *Saccharomyces* strain INVSc1 (Invitrogen) by means of electroporation (1500 V). As a control, pYES3 was transformed in parallel. Thereafter, the yeasts were plated onto complete tryptophan dropout minimal medium supplement with 2% glucose. Cells which are capable of growing on without tryptophan in the medium thus comprise the corresponding plasmids pYES3, pYES3-OmELO2 (SEQ ID NO: 51) and pYES3-OmELO3 (SEQ ID NO: 53). After the selection, in each case two transformants were selected for the further functional expression.

Example 5: Cloning Expression Plasmids for the Seed-Specific Expression in Plants To transform plants, a further transformation vector based on pSUN-USP was generated. To this end, NotI cleavage sites were introduced at the 5' and 3' termini of the coding sequence using the following primer pair:
PSUN-OmELO2

Forward:
(SEQ ID NO: 175)
5'-GCGGCCGCATAATGGCTTCAACATGGCAA

Reverse:
(SEQ ID NO: 176)
3'-GCGGCCGCTTATGTCTTCTTGCTCTTCCTGTT

PSUN-OmELO3

Forward:
(SEQ ID NO: 177)
5'-GCGGCCGCataatggagactttaat

-continued

Reverse:
(SEQ ID NO: 178)
3'-GCGGCCGCtcagtcccccctcactttcc

Composition of the PCR Mix (50 μl):
5.00 μl template cDNA
5.00 μl 10× buffer (Advantage polymerase)+25 mM MgCl$_2$
5.00 μl of 2 mM dNTP
1.25 μl of each primer (10 pmol/μl)
0.50 μl of Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR products were incubated with the restriction enzyme NotI for 16 hours at 37° C. The plant expression vector pSUN300-USP was incubated in the same manner. Thereafter, the PCR products and the 7624 bp vector were separated by agarose gel electrophoresis, and the corresponding DNA fragments were excised. The DNA was purified by means of the Qiagen Gel Purification Kit following the manufacturer's instructions. Thereafter, vector and PCR products were ligated. The Rapid Ligation Kit from Roche was used for this purpose. The resulting plasmids pSUN-OmELO2 and pSUN-OmELO3 were verified by sequencing.

pSUN300 is a derivative of the plasmid pPZP (Hajdukiewicz P., Svab, Z, Maliga P., (1994) The small versatile pPZP family of Agrobacterium binary vectors for plant transformation. Plant Mol. Biol. 25:989-994). pSUN-USP originated from pSUN300 by inserting a USP promoter as EcoRI fragment into pSUN 300. The polyadenylation signal is that of the octopin synthase gene from the A. tumefaciens Ti plasmid (ocs terminator, Genbank Accession V00088) (De Greve, H., Dhaese, P., Seurinck, J., Lemmers, M., Van Montagu, M. and Schell, J. Nucleotide sequence and transcript map of the Agrobacterium tumefaciens Ti plasmid-encoded octopine synthase gene J. Mol. Appl. Genet. 1 (6), 499-511 (1982). The USP promoter corresponds to the nucleotides 1-684 (Genbank Accession X56240), part of the noncoding region of the USP gene being present in the promoter. The promoter fragment, which is 684 base pairs in size, was amplified via a PCR reaction by standard methods, by means of commercially available T7 standard primer (Stratagene) and with the aid of a synthetized primer (primer sequence: 5'-GTCGACCCGCGGACTAGTGGGC-CCTCTAGACCCGGGGGATCCGGATCTGCTTGGC-TATGAA-3', SEQ ID NO: 174). The PCR fragment was recut with EcoRI/SalI and inserted into the vector pSUN300 with OCS terminator. This gave rise to the plasmid named pSUN-USP. The construct was used for transforming Arabidopsis thaliana, oilseed rape, tobacco and linseed.

Example 6: Lipid Extraction from Yeasts and Seeds

The effect of the genetic modification in plants, fungi, algae, ciliates or on the production of a desired compound (such as a fatty acid) can be determined by growing the modified microorganisms or the modified plant under suitable conditions (such as those described above) and analyzing the medium and/or the cellular components for the elevated production of the desired product (i.e. of the lipids or a fatty acid). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter 11, p. 1-27, VCH: Weinheim; and Dechow, F. J. (1989) Separation and purification techniques in biotechnology, Noyes Publications).

In addition to the abovementioned methods, plant lipids are extracted from plant material as described by Cahoon et al. (1999) Proc. Natl. Acad. Sci. USA 96 (22):12935-12940 and Browse et al. (1986) Analytic Biochemistry 152:141-145. The qualitative and quantitative analysis of lipids or fatty acids is described by Christie, William W., Advances in Lipid Methodology, Ayr/Scotland: Oily Press (Oily Press Lipid Library; 2); Christie, William W., Gas Chromatography and Lipids. A Practical Guide—Ayr, Scotland: Oily Press, 1989, Repr. 1992, IX, 307 pp. (Oily Press Lipid Library; 1); "Progress in Lipid Research, Oxford: Pergamon Press, 1 (1952)-16 (1977) under the title: Progress in the Chemistry of Fats and Other Lipids CODEN.

In addition to measuring the end product of the fermentation, it is also possible to analyze other components of the metabolic pathways which are used for the production of the desired compound, such as intermediates and by-products, in order to determine the overall production efficiency of the compound. The analytical methods comprise measuring the amount of nutrients in the medium (for example sugars, hydrocarbons, nitrogen sources, phosphate and other ions), measuring the biomass composition and the growth, analyzing the production of conventional metabolites of biosynthetic pathways and measuring gases which are generated during the fermentation. Standard methods for these measurements are described in Applied Microbial Physiology; A Practical Approach, P. M. Rhodes and P. F. Stanbury, Ed., IRL Press, p. 103-129; 131-163 and 165-192 (ISBN: 0199635773) and references cited therein.

One example is the analysis of fatty acids (abbreviations: FAME, fatty acid methyl ester; GC-MS, gas liquid chromatography/mass spectrometry; TAG, triacylglycerol; TLC, thin-layer chromatography).

The unambiguous detection for the presence of fatty acid products can be obtained by analyzing recombinant organisms using analytical standard methods: GC, GC-MS or TLC, as described on several occasions by Christie and the references therein (1997, in: Advances on Lipid Methodology, Fourth Edition: Christie, Oily Press, Dundee, 119-169; 1998, Gaschromatographie-Massenspektrometrie-Verfahren [Gas chromatography/mass spectrometric methods], Lipide 33:343-353).

The material to be analyzed can be disrupted by sonication, grinding in a glass mill, liquid nitrogen and grinding or via other applicable methods. After disruption, the material must be centrifuged. The sediment is resuspended in distilled water, heated for 10 minutes at 100° C., cooled on ice and recentrifuged, followed by extraction for one hour at 90° C. in 0.5 M sulfuric acid in methanol with 2% dimethoxypropane, which leads to hydrolyzed oil and lipid compounds, which give transmethylated lipids. These fatty acid methyl esters are extracted in petroleum ether and finally subjected to a GC analysis using a capillary column (Chrompack, WCOT Fused Silica, CP-Wax-52 CB, 25 m, 0.32 mm) at a temperature gradient of between 170° C. and 240° C. for 20 minutes and 5 minutes at 240° C. The identity of the resulting fatty acid methyl esters must be defined using standards which are available from commercial sources (i.e. Sigma).

Plant material is initially homogenized mechanically by comminuting in a pestle and mortar to make it more amenable to extraction.

This is followed by heating at 100° C. for 10 minutes and, after cooling on ice, by resedimentation. The cell sediment is hydrolyzed for one hour at 90° C. with 1 M methanolic sulfuric acid and 2% dimethoxypropane, and the lipids are transmethylated. The resulting fatty acid methyl esters (FAMEs) are extracted in petroleum ether. The extracted FAMEs are analyzed by gas liquid chromatography using a capillary column (Chrompack, WCOT Fused Silica, CP-Wax-52 CB, 25 m, 0.32 mm) and a temperature gradient of from 170° C. to 240° C. in 20 minutes and 5 minutes at 240° C. The identity of the fatty acid methyl esters is confirmed by comparison with corresponding FAME standards (Sigma). The identity and position of the double bond can be analyzed further by suitable chemical derivatization of the FAME mixtures, for example to give 4,4-dimethoxyoxazolin derivatives (Christie, 1998) by means of GC-MS.

Yeasts which had been transformed with the plasmids pYES3, pYES3-OmELO2 and pYES3-OmELO3 as described in Example 4 were analyzed as follows:

The yeast cells from the main cultures were harvested by centrifugation (100×g, 10 min, 20° C.) and washed with 100 mM NaHCO$_3$, pH 8.0 in order to remove residual medium and fatty acids. Fatty acid methyl esters (FAMEs) were prepared with the yeast cell sediments by acid methanolysis. To this end, the cell sediments were incubated for 1 hour at 80° C. with 2 ml of 1N methanolic sulfuric acid and 2% (v/v) dimethoxypropane. The FAMEs were extracted by twice extracting with petroleum ether (PE). To remove non-derivatized fatty acids, the organic phases were washed in each case once with 2 ml of 100 mM NaHCO$_3$, pH 8.0, and 2 ml of distilled water. Thereafter, the PE phases were dried with Na$_2$SO$_4$, evaporated under argon and taken up in 100 µl of PE. The samples were separated on a DB-23 capillary column (30 m, 0.25 mm, 0.25 µm, Agilent) in a Hewlett-Packard 6850 gas chromatograph with flame ionization detector. The conditions for the GLC analysis were as follows: the oven temperature was programmed from 50° C. to 250° C. with an increment of 5° C./min and finally 10 minutes at 250° C. (holding).

The signals were identified by comparing the retention times with corresponding fatty acid standards (Sigma).

The methodology is described for example in Napier and Michaelson, 2001, Lipids 36(8):761-766; Sayanova et al., 2001, Journal of Experimental Botany, 52(360):1581-1585, Sperling et al., 2001, Arch. Biochem. Biophys. 388(2):293-298 and Michaelson et al., 1998, FEBS Letters. 439(3):215-218.

Example 7: Functional Characterization of OmELO2 and OmELO3

OmELO2 shows no elongase activity, while a pronounced activity was detected for OmELO3, using different substrates. The substrate specificity of OmElo3 was determined after expression and feeding with various fatty acids (FIG. 2). The fed substrates can be detected in large amounts in all transgenic yeasts. All transgenic yeasts show that new fatty acids have been synthesized, to the products of the OmElo3 reaction. This means that the gene OmElo3 was expressed functionally.

FIG. 2 demonstrates that OmElo3 has a substrate specificity which leads to the elongation of Δ5- and Δ6-fatty acids with one w-double bond with high specificity. Moreover, ω6-fatty acids (C18 and C20) were also elongated, with less specificity. The best substrates for OmElo3 were stearidonic acid (C18:4 ω3) and eicosapentaenoic acid (C20:5 ω3) (up to 66% elongation).

Example 8: Reconstitution of the Synthesis of DHA in Yeast

The reconstitution of the biosynthesis of DHA (22:6 ω3) was carried out starting from EPA (20:5 ω3) or stearidonic acid (18:4 ω3) by coexpressing OmElo3 together with the *Euglena gracilis* Δ4-desaturase or the *Phaeodactylum tricornutum* Δ5-desaturase and the *Euglena gracilis* Δ4-desaturase. To this end, the expression vectors pYes2-EgD4 and pESCLeu-PtD5 were additionally constructed. The abovementioned yeast strain which is already transformed with pYes3-OmElo3 (SEQ ID NO: 55), was then transformed further with pYes2-EgD4, or simultaneously with pYes2-EgD4 and pESCLeu-PtD5. The transformed yeasts were selected on complete minimal dropout tryptophan and uracil medium agar plates supplemented with 2% glucose in the case of the pYes3-pYes3-OmElO/pYes2-EgD4 strain and complete minimal dropout tryptophan, uracil and leucine medium in the case of the pYes3-OmElO/pYes2-EgD4+ pESCLeu-PtD5 strain. Expression was then induced by addition of 2% (w/v) galactose. The cultures were subsequently incubated for a further 120 hours at 15° C.

FIG. 3 shows the fatty acid profiles of transgenic yeasts which have been fed 20:5 ω3. In the control yeast (A), which had been transformed with the vector pYes3-OmElo3 and the blank vector pYes2, 20:5 ω3 was elongated highly efficiently to give 22:5 ω3 (65% elongation). The additional introduction of the EEgΔ4-desaturase led to the conversion of 22:5 ω3 into 22:6 ω3 DHA. The fatty acid composition of the transgenic yeasts is shown in FIG. 5. After coexpression of OmElo3 and EgD4, up to 3% DHA was detected in yeasts.

In a further coexpression experiment, OmElo3, EgD4 and a Δ5-desaturase from *P. tricornutum* (PtD5) were expressed together. The transgenic yeasts were fed stearidonic acid (18:4 ω3) and analyzed (FIG. 4). The fatty acid composition of these yeasts is shown in FIG. 5. OmElo3 elongated the fed fatty acid 18:4 ω3 to give 20:4 ω3 (60% elongation). The latter was desaturated by PtD5 to give 20:5 ω3. The PtD5 activity amounted to 15%. Furthermore, 20:5 ω3 was elongated by EmElo3 to give 22:5 ω3. Thereafter, the newly synthesized 22:5 ω3 was desaturated to give 22:6 ω3 (DHA). Up to 0.7% of DHA was obtained in these experiments.

These experiments demonstrate that the sequences OmElo3, EgD4 and PtD5 which are used in the present invention are suitable for the production of DHA in eukaryotic cells.

Example 9: Generation of Transgenic Plants a) Generation of Transgenic Oilseed Rape Plants (Modified Process of Moloney et al., 1992, Plant Cell Reports, 8:238-242)

The binary vectors in *Agrobacterium tumefaciens* C58C1: pGV2260 or *Escherichia coli* (Deblaere et al, 1984, Nucl. Acids. Res. 13, 4777-4788) can be used for generating transgenic oilseed rape plants. To transform oilseed rape plants (Var. Drakkar, NPZ Nordeutsche Pflanzenzucht, Hohenlieth, Germany), a 1:50 dilution of an overnight culture of a positively transformed agrobacterial colony in Murashige-Skoog medium (Murashige and Skoog 1962 Physiol. Plant. 15, 473) supplemented with 3% sucrose (3MS medium) is used. Petiols or hypocotyls of freshly germinated sterile oilseed rape plants (in each case approx. 1 cm$^2$) are incubated with a 1:50 agrobacterial dilution for 5-10 minutes in a petri dish. This is followed by 3 days of coincubation in the dark at 25° C. on 3MS medium supplemented with 0.8% Bacto agar. The cultures are then grown for 3 days at 16 hours light/8 hours dark. The cultivation is then continued in a weekly rhythm on MS medium supplemented with 500 mg/l Claforan (cefotaxim sodium), 50 mg/l kanamycin, 20 µM benzylaminopurine (BAP), now supplemented with 1.6 g/l of glucose. Growing shoots are transferred to MS medium supplemented with 2% sucrose, 250 mg/l Claforan and 0.8% Bacto agar. If no roots have developed after three weeks, 2-indolebutyric acid is added to the medium as growth hormone for rooting.

Regenerated shoots were obtained on 2MS medium supplemented with kanamycin and Claforan; after rooting, they were transferred to compost and, after growing on for two weeks in a controlled-environment cabinet or in the greenhouse, allowed to flower, and mature seeds were harvested and analyzed by lipid analysis for elongase expression, such as Δ5-elongase or Δ6-elongase activity. In this manner, lines with elevated contents of polyunsaturated C$_{20}$- and C$_{22}$-fatty acids can be identified.

b) Generation of Transgenic Linseed Plants

Transgenic linseed plants can be generated for example by the process of Bell et al., 1999, In Vitro Cell. Dev. Biol.-Plant. 35(6):456-465 by means of particle bombardment. Usually, an agrobacteria-mediated transformations was used for the transformation of linseed, for example by the process of Mlynarova et al. (1994), Plant Cell Report 13: 282-285.

Example 10: Cloning Δ5-Elongase Genes from *Thraustochytrium aureum* ATCC34304 and *Thraustochytrium* Ssp Comparisons of the various elongase protein sequences found in the present application enabled the definition of conserved nucleic acid regions (histidin box: His-Val-X-His-His, tyrosin box: Met-Tyr-X-Tyr-Tyr). An EST database of *T. aureum* ATCC34304 and *Thraustochytrium* ssp. was screened for further Δ5-elongases with the aid of these sequences. The following new sequences were found:

| Name of gene | Nucleotides | Amino acids |
|---|---|---|
| BioTaurELO1 | 828 bp | 275 |
| TL16y2 | 831 | 276 |

Total RNA from *T. aureum* ATCC34304 and *Thraustochytrium* ssp. was isolated with the aid of the RNAeasy Kits from Qiagen (Valencia, Calif., US). mRNA was isolated from the total RNA with the aid of the polyATract isolation system (Promega). The mRNA was subjected to reverse transcription using the Marathon cDNA Amplification Kit (BD Biosciences) and adaptors were ligated in accordance with the manufacturer's instructions. The cDNA library was then employed for the PCR for cloning expression plasmids by means of 5'- and 3'-RACE (rapid amplification of cDNA ends).

Example 11: Cloning Expression Plasmids for the Heterologous Expression in Yeasts To clone the sequence for heterologous expression in yeasts, the following oligonucleotides were used for the PCR reaction:

| Primer | Nucleotide sequence |
|---|---|
| 5' f* BioTaurELO1 | 5' gacataatgacgagcaacatgag (SEQ ID NO: 170) |
| 3' r* BioTaurELO1 | 5' cggcttaggccgacttggccttggg (SEQ ID NO: 171) |
| 5' f* TL16y2 | 5' agacataatggacgtcgtcgagcagcaatg (SEQ ID NO: 172) |
| 3' r* TL16y2 | 5' ttagatggtcttctgcttcttgggcgcc (SEQ ID NO: 173) |

*f: forward, r: reverse

Composition of the PCR Mix (50 µl):
5.00 µl template cDNA
5.00 µl 10× buffer (Advantage polymerase)+25 mM MgCl$_2$
5.00 µl of 2 mM dNTP
1.25 µl of each primer (10 pmol/µl)
0.50 µl of Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR products BioTaurELO1 (see (SEQ ID NO: 65) and TL16y2 (see SEQ ID NO: 83) were incubated for 30 minutes at 21° C. with the yeast expression vector pYES2.1-TOPO (Invitrogen) following the manufacturer's instructions. The PCR product is ligated into the vector by means of a T overhang and activity of a topoisomerase (Invitrogen). After incubation, *E. coli* DH5α cells were transformed. Suitable clones were identified by PCR, the plasmid DNA was isolated by means of Qiagen DNAeasy Kit and verified by sequencing. The correct sequence was then transformed into the *Saccharomyces* strain INVSc1 (Invitrogen) by electroporation (1500 V). As a control, the blank vector pYES2.1 was transformed in parallel. The yeasts were subsequently plated onto complete uracil dropout minimal medium supplemented with 2% glucose. Cells which were capable of growing in the medium without uracil thus comprise the corresponding plasmids pYES2.1, pYES2.1-BioTaurELO1 and pYES2.1-TL16y2. After the selection, in each case two transformants were selected for further functional expression.

Example 12: Cloning Expression Plasmids for the Seed Specific Expression in Plants A further transformation vector based on pSUN-USP was generated for the transformation of plants. To this end, NotI cleavage sites were introduced at the 5' and 3' termini of the coding sequence, using the following primer pair:
PSUN-BioTaurELO1

Forward:
(SEQ ID NO: 166)
5'-GCGGCCGCATAATGACGAGCAACATGAGC

Reverse:
(SEQ ID NO: 167)
3'-GCGGCCGCTTAGGCCGACTTGGCCTTGGG

PSUN-TL16y2

```
Forward:
                                    (SEQ ID NO: 168)
5'-GCGGCCGCACCATGGACGTCGTCGAGCAGCAATG Reverse:
                                    (SEQ ID NO: 169)
5'-GCGGCCGCTTAGATGGTCTTCTGCTTCTTGGGCGCC
```

Composition of the PCR Mix (50 µl):
5.00 µl template cDNA
5.00 µl 10× buffer (Advantage polymerase)+25 mM MgCl$_2$
5.00 µl 2 mM dNTP
1.25 µl of each primer (10 pmol/µl)
0.50 µl Advantage polymerase
The Advantage polymerase from Clontech was employed.
PCR Reaction Conditions:
Annealing temperature: 1 min 55° C.
Denaturation temperature: 1 min 94° C.
Elongation temperature: 2 min 72° C.
Number of cycles: 35

The PCR products were incubated with the restriction enzyme NotI for 16 hours at 37° C. The plant expression vector pSUN300-USP was incubated in the same manner. Thereafter, the PCR products and the 7624 bp vector were separated by agarose gel electrophoresis and the corresponding DNA fragments were excised. The DNA was purified by means of the Qiagen Gel Purification Kit following the manufacturer's instructions. Thereafter, vector and PCR products were ligated. The Rapid Ligation Kit from Roche was used for this purpose. The resulting plasmids pSUN-BioTaurELO1 and pSUN-TL16y2 were verified by sequencing.

pSUN300 is a derivative of plasmid pPZP (Hajdukiewicz, P, Svab, Z, Maliga, P., (1994) The small versatile pPZP family of Agrobacterium binary vectors for plant transformation. Plant Mol Biol 25:989-994). pSUN-USP originated from pSUN300, by inserting a USP promoter into pSUN300 in the form of an EcoRI fragment. The polyadenylation signal is that of the octopine synthase gene from the A. tumefaciens Ti plasmid (ocs-Terminator, Genbank Accession V00088) (De Greve, H., Dhaese, P., Seurinck, J., Lemmers, M., Van Montagu, M. and Schell, J. Nucleotide sequence and transcript map of the Agrobacterium tumefaciens Ti plasmid-encoded octopine synthase gene J. Mol. Appl. Genet. 1 (6), 499-511 (1982)). The USP promoter corresponds to nucleotides 1 to 684 (Genbank Accession X56240), where part of the noncoding region of the USP gene is present in the promoter. The promoter fragment which is 684 base pairs in size was amplified by a PCR reaction and standard methods with the aid of a synthesized primer and by means of a commercially available T7 standard primer (Stratagene). (Primer sequence: 5'-GTCGAC-CCGCGGACTAGTGGGCCCTCTAGAC-CCGGGGGATCCGGATCTGCTGGCTATGAA-3', SEQ ID NO: 165). The PCR fragment was recut with EcoRI/SalI and inserted into the vector pSUN300 with OCS terminator. This gave rise to the plasmid with the name pSUN-USP. The construct was used for the transformation of Arabidopsis thaliana, oilseed rape, tobacco and linseed.

Lipids were extracted from yeasts and seeds as described for Example 6.

Example 13: Functional Characterization of BioTaurELO1 and TL16y2

The substrate specificity of BioTaurELO1 was determined after expression and feeding of various fatty acids (FIG. 6). FIG. 6 shows the feeding experiments for determining the functionality and substrate specificity with yeast strains comprising either the vector pYes2.1 (control) or the vector pYes2.1-BioTaurELO1 (=BioTaur) with the Δ5-elongase. In both approaches, 200 µm of γ-linolenic acid and eicosapentaenoic acid were added to the yeast incubation medium and incubated for 24 hours. After the fatty acids had been extracted from the yeasts, they were transmethylated and separated by gas chromatography. The elongation products originating from the two fatty acids which had been fed are identified by arrows.

The substrates which had been fed can be detected in large amounts in all transgenic yeasts. All transgenic yeasts show that new fatty acids have been synthesized, the products of the BioTaurELO1 reaction. This means that the gene BioTaurELO1 has been expressed functionally.

FIG. 6 shows that BioTaurELO1 has a substrate specificity which leads with high specificity to the elongation of Δ5- and Δ6-fatty acids with one ω3-double bond. Moreover, ω6-fatty acids (C18 and C20) were also elongated. γ-Linolenic acid (C18:3 ω6) is converted with a conversion rate of 65.28%, stearidonic acid (C18:4 ω3) with a conversion rate of 65.66% and eicosapentaenoic acid (C20:5 ω3) with a conversion rate of 22.01%. The substrate specificities of the various feeding experiments are shown in Table 6 (see end of the description).

The conversion rate of GLA when feeding GLA and EPA was 65.28%. The conversion rate of EPA, again when feeding GLA and EPA, was 9.99%. When only EPA was fed, the EPA conversion rate was 22.01%. Arachidonic acid (=ARA) was also converted when fed. The conversion rate was 14.47%. Stearidonic acid (=SDA) was also converted. In this case, the conversion rate was 65.66%.

The functionality and substrate specificity of TL16y2 were determined after expression and feeding of various fatty acids. Table 7 shows the feeding experiments. The feeding experiments were carried out in the same manner as described for BioTaurELO1. The substrates which have been fed can be detected in large amounts in all transgenic yeasts. The transgenic yeasts demonstrated the synthesis of novel fatty acids, the products of the TL16y2 reaction (FIG. 11). This means that the gene TL16y2 has been expressed functionally.

TABLE 7

Expression of TL16y2 in yeast.
% areas in the gas-chromatographic analysis

| Plasmid | Fatty acid | C18:3 (n-6) | C18:4 (n-3) | C20:3 (n-6) | C20:4 (n-6) | C20:4 (n-3) | C20:5 (n-3) | C22:4 (n-6) | C22:5 (n-3) |
|---|---|---|---|---|---|---|---|---|---|
| pYES | 250 µm EPA | | | | | | 13.79 | | |

TABLE 7-continued

Expression of TL16y2 in yeast.
% areas in the gas-chromatographic analysis

| Plasmid | Fatty acid | C18:3 (n-6) | C18:4 (n-3) | C20:3 (n-6) | C20:4 (n-6) | C20:4 (n-3) | C20:5 (n-3) | C22:4 (n-6) | C22:5 (n-3) |
|---|---|---|---|---|---|---|---|---|---|
| TL16y2 | 250 μm EPA | | | | | | 25.81 | | 2.25 |
| pYES | 50 μm EPA | | | | | | 5.07 | | |
| TL16y2 | 50 μm EPA | | | | | | 2.48 | | 1.73 |
| pYES | 250 μm GLA | 8.31 | | | | | | | |
| TL16y2 | 250 μm GLA | 3.59 | | 10.71 | | | | | |
| pYES | 250 μm ARA | | | | 16.03 | | | | |
| TL16y2 | 250 μm ARA | | | | 15.2 | | | 3.87 | |
| pYES | 250 μm SDA | | 26.79 | | | 0.35 | | | |
| TL16y2 | 250 μm SDA | | 7.74 | | | 29.17 | | | |

The results with TL16y2, which are shown in Table 7, show the following conversion rates in % of the control: a) conversion rate of EPA in % (250 μm): 8%, b) conversion rate of EPA in % (50 μm): 41%; c) conversion rate of ARA in %: 20.3%, d) conversion rate of SDA in %: 79.4%, and e) conversion rate of GLA in %: 74.9%.

Thus, TL16y2 shows Δ5-, Δ6- and Δ8-elongase activity. The activity is highest for C18-fatty acids with Δ6-double bond. Then, C20-fatty acids with a Δ5- or Δ8-double bond are elongated, depending on the concentration of fatty acids which are fed.

Example 14: Cloning Genes from *Ostreococcus tauri*

The search for conserved regions in the protein sequences with the aid of the elongase genes with Δ5-elongase activity or Δ6-elongase activity which are shown in the application allowed the identification of sequences with suitable motifs in an *Ostreococcus tauri* sequence database (genomic sequences).

The sequences were the following:

| Name of gene | SEQ ID | Amino acids |
|---|---|---|
| OtELO1, (Δ5-elongase) | SEQ ID NO: 67 | 300 |
| OtELO2, (Δ6-elongase) | SEQ ID NO: 69 | 292 |

OtElo1 shows the highest similarity with an elongase from *Danio rerio* (GenBank AAN77156; identity approx. 26%), while OtElo2 shows the highest similarity with the *Physcomitrella* Elo (PSE) [approx. 36% identity] (alignments were carried out using the tBLASTn algorithm (Altschul et al., J. Mol. Biol. 1990, 215: 403-410).

The cloning procedure was as follows:
40 ml of an *Ostreococcus tauri* culture in the stationary phase were spun down, resuspended in 100 μl of double-distilled water and stored at −20° C. The respective genomic DNAs were amplified on the basis of the PCR process. The relevant primer pairs were selected in such a way that they bore the yeast consensus sequence for highly efficient translation (Kozak, Cell 1986, 44:283-292) next to the start codon. The amplification of the OtElo DNAs was carried out in each case using 1 μl of defrosted cells, 200 μm of dNTPs, 2.5 U Taq polymerase and 100 pmol of each primer in a total volume of 50 μl. The PCR conditions were as follows: first denaturation for 5 minutes at 95° C., followed by 30 cycles of 30 seconds at 94° C., 1 minute at 55° C. and 2 minutes at 72° C., and a last elongation step of 10 minutes at 72° C.

Example 15: Cloning Expression Plasmids for the Heterologous Expression in Yeasts To characterize the function of the *Ostreococcus tauri* elongases, the open reading frames of the DNAs in question were cloned downstream of the galactose-inducible GAL1 promoter of pYES2.1N5-His-TOPO (Invitrogen), giving rise to pOTE1 and pOTE2.

The *Saccharomyces cerevisiae* strain 334 was transformed by electroporation (1500 v) with the vector pOTE1 or pOTE2. A yeast which was transformed with the blank vector pYES2 was used as the control. The transformed yeasts were selected on complete minimal dropout uracil medium (CMdum) agar plates supplemented with 2% glucose. After the selection, in each case three transformants were selected for the further functional expression.

To express the Ot elongases, precultures of in each case 5 ml of dropout uracil CMdum liquid medium supplemented with 2% (w/v) raffinose were inoculated with the selected transformants and incubated for 2 days at 30° C., 200 rpm.

5 ml of CMdum liquid medium (without uracil) supplemented with 2% raffinose and 300 μm of various fatty acids were then inoculated with the precultures to an OD$_{600}$ of 0.05. The expression was induced by addition of 2% (w/v) galactose. The cultures were incubated for a further 96 hours at 20° C.

Example 16: Cloning of Expression Plasmids for the Seed-Specific Expression in Plants A further transformation vector based on pSUN-USP was generated for the transformation of plants. To this end, NotI cleavage sites were introduced at the 5' and 3' termini of the coding sequences, using PCR. The corresponding primer sequences are derived from the 5' and 3' regions of OtElo1 and OtElo2.

Composition of the PCR Mix (50 µl):
5.00 µl template cDNA
5.00 µl 10× buffer (Advantage polymerase)+25 mM MgCl$_2$
5.00 µl 2 mM dNTP
1.25 µl of each primer (10 pmol/µl)
0.50 µl Advantage polymerase
The Advantage polymerase from Clontech was employed.
PCR Reaction Conditions:
Annealing temperature: 1 min 55° C.
Denaturation temperature: 1 min 94° C.
Elongation temperature: 2 min 72° C.
Number of cycles: 35

The PCR products were incubated with the restriction enzyme NotI for 16 hours at 37° C. The plant expression vector pSUN300-USP was incubated in the same manner. Thereafter, the PCR products and the vector were separated by agarose gel electrophoresis and the corresponding DNA fragments were excised. The DNA was purified by means of the Qiagen Gel Purification Kit following the manufacturer's instructions. Thereafter, vector and PCR products were ligated. The Rapid Ligation Kit from Roche was used for this purpose. The resulting plasmids pSUN-OtELO1 and pSUN-OtELO2 were verified by sequencing.

pSUN300 is a derivative of plasmid pPZP (Hajdukiewicz, P, Svab, Z, Maliga, P., (1994) The small versatile pPZP family of Agrobacterium binary vectors for plant transformation. Plant Mol Biol 25:989-994). pSUN-USP originated from pSUN300, by inserting a USP promoter into pSUN300 in the form of an EcoRI fragment. The polyadenylation signal is that of the Ostreococcys gene from the A. tumefaciens Ti plasmid (ocs-Terminator, Genbank Accession V00088) (De Greve, H., Dhaese, P., Seurinck, J., Lemmers, M., Van Montagu, M. and Schell, J. Nucleotide sequence and transcript map of the Agrobacterium tumefaciens Ti plasmid-encoded octopine synthase gene J. Mol. Appl. Genet. 1 (6), 499-511 (1982)). The USP promoter corresponds to nucleotides 1 to 684 (Genbank Accession X56240), where part of the noncoding region of the USP gene is present in the promoter. The promoter fragment which is 684 base pairs in size was amplified by a PCR reaction and standard methods with the aid of a synthesized primer and by means of a commercially available T7 standard primer (Stratagene). (Primer sequence: 5'-GTCGAC-CCGCGGACTAGTGGGCCCTCTAGAC-CCGGGGGATCCGGATCTGCTGGCTATGAA-3', SEQ ID NO: 164).

The PCR fragment was recut with EcoRI/SalI and inserted into the vector pSUN300 with OCS terminator. This gave rise to the plasmid with the name pSUN-USP. The construct was used for the transformation of *Arabidopsis thaliana*, oilseed rape, tobacco and linseed.

Example 17: Expression of OtELO1 and OtELO2 in Yeasts

Yeasts which had been transformed with the plasmids pYES3, pYES3-OtELO1 and pYES3-OtELO2 as described in Example 15 were analyzed as follows:

The yeast cells from the main cultures were harvested by centrifugation (100×g, 5 min, 20° C.) and washed with 100 mM NaHCO$_3$, pH 8.0 to remove residual medium and fatty acids. Starting with the yeast cell sediments, fatty acid methyl esters (FAMEs) were prepared by acid methanolysis. To this end, the cell sediments were incubated for one hour at 80° C. together with 2 ml of 1 N methanolic sulfuric acid and 2% (v/v) of dimethoxypropane. The FAMEs were extracted twice with petroleum ether (PE). To remove non-derivatized fatty acids, the organic phases were washed in each case once with 2 ml of 100 mM NaHCO$_3$, pH 8.0 and 2 ml of distilled water. Thereafter, the PE phases were dried with Na$_2$SO$_4$, evaporated under argon and taken up in 100 µl of PE. The samples were separated on a DB-23 capillary column (30 m, 0.25 mm, 0.25 µm, Agilent) in a Hewlett-Packard 6850 gas chromatograph equipped with flame ionization detector. The conditions for the GLC analysis were as follows: the oven temperature was programmed from 50° C. to 250° C. with an increment of 5° C./min and finally 10 min at 250° C. (holding).

The signals were identified by comparing the retention times with corresponding fatty acid standards (Sigma). The methodology is described for example in Napier and Michaelson, 2001, Lipids. 36(8):761-766; Sayanova et al., 2001, Journal of Experimental Botany. 52(360):1581-1585, Sperling et al., 2001, Arch. Biochem. Biophys. 388(2):293-298 and Michaelson et al., 1998, FEBS Letters. 439(3):215-218.

Example 18: Functional Characterization of OtELO1 and OtELO2

The substrate specificity of OtELo1 could be determined after expression and the feeding of different fatty acids (Tab. 8). The substrates fed can be detected in large amounts in all of the transgenic yeasts. The transgenic yeasts demonstrated the synthesis of novel fatty acids, the products of the OtElo1 reaction. This means that the gene OtElo1 has been expressed functionally.

It can be seen from Table 7 that OtElo1 has a narrow substrate specificity. OtElo1 was only capable of elongating the C20-fatty acids eicosapentaenoic acid (FIG. 7) and arachidonic acid (FIG. 8), but preferred the ω3-desaturated eicosapentaenoic acid.

TABLE 8

| Fatty acid substrate | Conversion rate (in %) |
|---|---|
| 16:0 | — |
| 16:1$^{\Delta 9}$ | |
| 18:0 | — |
| 18:1$^{\Delta 9}$ | |
| 18:1$^{\Delta 11}$ | — |
| 18:2$^{\Delta 9,12}$ | |
| 18:3$^{\Delta 6,9,12}$ | — |
| 18:3$^{\Delta 5,9,12}$ | — |
| 20:3$^{\Delta 8,11,14}$ | |
| 20:4$^{\Delta 5,8,11,14}$ | 10.8 ± 0.6 |
| 20:5$^{\Delta 5,8,11,14,17}$ | 46.8 ± 3.6 |
| 22:4$^{\Delta 7,10,13,16}$ | — |
| 22:6$^{\Delta 4,7,10,13,16,19}$ | — |

Table 8 shows the substrate specificity of the elongase OtElo1 for C20-polyunsaturated fatty acids with one double bond in Δ5-position in comparison with various fatty acids.

The yeasts which had been transformed with the vector pOTE1 were cultured in minimal medium in the presence of the fatty acids detailed. The fatty acid methyl esters were synthesized by subjecting intact cells to acid methanolysis. Thereafter, the FAMEs were analyzed via GLC. Each value represents the mean (n=3)±standard deviation.

The substrate specificity of OtELo2 (SEQ ID NO: 81) could be determined after expression and the feeding of different fatty acids (Tab. 9). The substrates fed could be detected in large amounts in all of the transgenic yeasts. The transgenic yeasts demonstrated the synthesis of novel fatty acids, the products of the OtElo2 reaction. This means that the gene OtElo2 has been expressed functionally.

TABLE 9

| Fatty acid substrate | Conversion rate (in %) |
|---|---|
| 16:0 | — |
| 16:1$^{\Delta 9}$ | |
| 16:3$^{\Delta 7,10,13}$ | |
| 18:0 | — |
| 18:1$^{\Delta 0}$ | — |
| 18:1$^{\Delta 9}$ | — |
| 18:1$^{\Delta 11}$ | — |
| 18:2$^{\Delta 9,12}$ | — |
| 18:3$^{\Delta 6,9,12}$ | 15.3± |
| 18:3$^{\Delta 5,9,12}$ | — |
| 18:4$^{\Delta 6,9,12,15}$ | 21.1± |
| 20:2$^{\Delta 11,14}$ | — |
| 20:3$^{\Delta 8,11,14}$ | — |
| 20:4$^{\Delta 5,8,11,14}$ | — |
| 20:5$^{\Delta 5,8,11,14,17}$ | — |
| 22:4$^{\Delta 7,10,13,16}$ | — |
| 22:5$^{\Delta 7,10,13,16,19}$ | — |
| 22:6$^{\Delta 4,7,10,13,16,19}$ | — |

Table 9 shows the substrate specificity of the elongase OtElo2 for various fatty acids.

The yeasts which had been transformed with the vector pOTE2 were cultured in minimal medium in the presence of the fatty acids detailed. The fatty acid methyl esters were synthesized by subjecting intact cells to acid methanolysis. Thereafter, the FAMEs were analyzed via GLC. Each value represents the mean (n=3)±standard deviation.

The enzymatic activity shown in Table 9 clearly demonstrates that OTELO2 is a Δ6-elongase.

Example 19: Cloning Genes from *Thalassiosira pseudonana*

The search for conserved regions in the protein sequences with the aid of the elongase genes with Δ5-elongase activity or Δ6-elongase activity which are shown in the application allowed the identification of two sequences with suitable motifs in a *Thalassiosira pseudonana* sequence database (genomic sequences). The sequences were the following:

| Name of gene | SEQ ID | Amino acids |
|---|---|---|
| TpELO1 (Δ5-elongase) | 43 | 358 |
| TpELO2 (Δ5-elongase) | 59 | 358 |
| TpELO3 (Δ6-elongase) | 45 | 272 |

A 2 l culture of *T. pseudonana* was grown in f/2 medium (Guillard, R. R. L. 1975. Culture of phytoplankton for feeding marine invertebrates. In *Culture of Marine Invertebrate Animals* (Eds. Smith, W. L. and Chanley, M. H.), Plenum Press, New York, pp 29-60) for 14 d (=days) at a light intensity of 80 E/cm². After the cells had been spun down, RNA was isolated with the aid of the RNAeasy Kit from Quiagen (Valencia, Calif., US) following the manufacturer's instructions. The mRNA was subjected to reverse transcription using the Marathon cDNA Amplification Kit (BD Biosciences) and adaptors were ligated in accordance with the manufacturer's instructions. Then, the cDNA library was used for the PCR for cloning expression plasmids by means of 5'- and 3'-RACE (rapid amplification of cDNA ends).

Example 20: Cloning Expression Plasmids for the Heterologous Expression in Yeasts The relevant primer pairs were selected in such a way that they bore the yeast consensus sequence for highly efficient translation (Kozak, Cell 1986, 44:283-292) next to the start codon. The amplification of the TpElo DNAs was carried out in each case using 1 μl of cDNA, 200 μm of dNTPs, 2.5 U of Advantage polymerase and 100 pmol of each primer in a total volume of 50 μl. The PCR conditions were as follows: first denaturation for 5 minutes at 95° C., followed by 30 cycles of 30 seconds at 94° C., 1 minute at 55° C. and 2 minutes at 72° C., and a last elongation step of 10 minutes at 72° C.

To clone the sequence for the heterologous expression in yeasts, the following oligonucleotides were used for the PCR reaction:

| Name of gene and SEQ ID NO: | Primer sequence |
|---|---|
| TpELO1 (Δ5-elongase), SEQ ID NO: 59 | F:5'-accatgtgctcaccaccgccgtc (SEQ ID NO: 158) R:5'-ctacatggcaccagtaac (SEQ ID NO: 159) |
| TpELO2 (Δ5-elongase), SEQ ID NO: 85 | F:5'-accatgtgctcatcaccgccgtc (SEQ ID NO: 160) R:5'-ctacatggcaccagtaac (SEQ ID NO: 161) |
| TpELO3 (Δ6-elongase), SEQ ID NO: 45 | F:5'-accatggacgcctacaacgctgc (SEQ ID NO: 162) R:5'-ctaagcactcttcttcttt (SEQ ID NO: 163) |

*F = forward primer, R = reverse primer

The PCR products were incubated for 30 minutes at 21° C. with the yeast expression vector pYES2.1-TOPO (Invitrogen) following the manufacturer's instructions. The PCR product is ligated into the vector by means of a T overhang and activity of a topoisomerase (Invitrogen). After incubation, *E. coli* DH5α cells were transformed. Suitable clones were identified by PCR, the plasmid DNA was isolated by means of Qiagen DNAeasy Kit and verified by sequencing. The correct sequence was then transformed into the *Saccharomyces* strain INVSc1 (Invitrogen) by electroporation (1500 V). As a control, the blank vector pYES2.1 was transformed in parallel. The yeasts were subsequently plated onto complete uracil dropout minimal medium supplemented with 2% glucose. Cells which were capable of growing in the medium without uracil thus comprise the corresponding plasmids pYES2.1, pYES2.1-TpELO1, pYES2.1-TpELO2 and pYES2.1-TpELO3. After the selection, in each case two transformants were selected for further functional expression.

Example 21: Cloning Expression Plasmids for the Seed Specific Expression in Plants A further transformation vector based on pSUN-USP is generated for the transformation of plants. To this end, NotI cleavage sites are introduced at the 5' and 3' termini of the coding sequences, using the following primer pair:
PSUN-TPELO1

Forward:
(SEQ ID NO: 152)
5'-GCGGCCGCACCATGTGCTCACCACCGCCGTC

-continued

Reverse:
(SEQ ID NO: 153)
3'-GCGGCCGCCTACATGGCACCAGTAAC

PSUN-TPELO2

Forward:
(SEQ ID NO: 154)
5'-GCGGCCGCACCATGTGCTCATCACCGCCGTC

Reverse:
(SEQ ID NO: 155)
3'-GCGGCCGCCTACATGGCACCAGTAAC

PSUN-TPELO3

Forward:
(SEQ ID NO: 156)
5'-GCGGCCGCaccatggacgcctacaacgctgc

Reverse:
(SEQ ID NO: 157)
3'-GCGGCCGCCTAAGCACTCTTCTTCTTT

Composition of the PCR Mix (50 µl):
5.00 µl template cDNA
5.00 µl 10× buffer (Advantage polymerase)+25 mM $MgCl_2$
5.00 µl 2 mM dNTP
1.25 µl of each primer (10 pmol/µl)
0.50 µl Advantage polymerase
The Advantage polymerase from Clontech was employed.
PCR Reaction Conditions:
Annealing temperature: 1 min 55° C.
Denaturation temperature: 1 min 94° C.
Elongation temperature: 2 min 72° C.
Number of cycles: 35

The PCR products are incubated with the restriction enzyme NotI for 16 hours at 37° C. The plant expression vector pSUN300-USP is incubated in the same manner. Thereafter, the PCR products and the 7624 bp vector are separated by agarose gel electrophoresis and the corresponding DNA fragments are excised. The DNA is purified by means of the Qiagen Gel Purification Kit following the manufacturer's instructions. Thereafter, vector and PCR products are ligated. The Rapid Ligation Kit from Roche is used for this purpose. The resulting plasmids pSUN-TPELO1, pSUN-TPELO2 and pSUN-TPELO3 are verified by sequencing.

pSUN300 is a derivative of plasmid pPZP (Hajdukiewicz, P, Svab, Z, Maliga, P., (1994) The small versatile pPZP family of Agrobacterium binary vectors for plant transformation. Plant Mol Biol 25:989-994). pSUN-USP originated from pSUN300, by inserting a USP promoter into pSUN300 in the form of an EcoRI fragment. The polyadenylation signal is that of the octopine synthase gene from the A. tumefaciens Ti plasmid (ocs-Terminator, Genbank Accession V00088) (De Greve, H., Dhaese, P., Seurinck, J., Lemmers, M., Van Montagu, M. and Schell, J. Nucleotide sequence and transcript map of the Agrobacterium tumefaciens Ti plasmid-encoded octopine synthase gene J. Mol. Appl. Genet. 1 (6), 499-511 (1982)). The USP promoter corresponds to nucleotides 1 to 684 (Genbank Accession X56240), where part of the noncoding region of the USP gene is present in the promoter. The promoter fragment which is 684 base pairs in size was amplified by a PCR reaction and standard methods with the aid of a synthesized primer and by means of a commercially available T7 standard primer (Stratagene).

(Primer sequence:
5'-GTCGACCCGCGGACTAGTGGGCCCTCTAGACCCGGGGGATCC
GGATCTGCTGGCTATGAA-3'); SEQ ID NO: 151).

The PCR fragment was recut with EcoRI/SalI and inserted into the vector pSUN300 with OCS terminator. This gave rise to the plasmid with the name pSUN-USP. The construct was used for the transformation of *Arabidopsis thaliana*, oilseed rape, tobacco and linseed.

Lipids were extracted from yeasts and seeds as described for Example 6.

Example 22: Expression of TpELO1, TpELO2 and TpELO3 in Yeasts

Yeasts which had been transformed with the plasmids pYES2, pYES2-TpELO1, pYES2-TpELO2 and pYES2-TpELO3 as in Example 4 were analyzed as follows:

The yeast cells from the main cultures were harvested by centrifugation (100×g, 5 min, 20° C.) and washed with 100 mM $NaHCO_3$, pH 8.0 in order to remove residual medium and fatty acids. Fatty acid methyl esters (FAMEs) were prepared from the yeast cell sediments by acid methanolysis. To this end, the cell sediments were incubated for 1 hour at 80° C. with 2 ml of 1 N methanolic sulfuric acid and 2% (v/v) dimethoxypropane. The FAMEs were extracted by twice extracting with petroleum ether (PE). To remove nonderivatized fatty acids, the organic phases were washed in each case once with 2 ml of 100 mM $NaHCO_3$, pH 8.0, and 2 ml of distilled water. Thereafter, the PE phases were dried with $Na_2SO_4$, evaporated under argon and taken up in 100 µl of PE. The samples were separated on a DB-23 capillary column (30 m, 0.25 mm, 0.25 µm, Agilent) in a Hewlett-Packard 6850 gas chromatograph with flame ionization detector. The conditions for the GLC analysis were as follows: the oven temperature was programmed from 50° C. to 250° C. with an increment of 5° C./min and finally 10 minutes at 250° C. (holding).

The signals were identified by comparing the retention times with corresponding fatty acid standards (Sigma). The methodology is described for example in Napier and Michaelson, 2001, Lipids 36(8):761-766; Sayanova et al., 2001, Journal of Experimental Botany, 52(360):1581-1585, Sperling et al., 2001, Arch. Biochem. Biophys. 388(2):293-298 and Michaelson et al., 1998, FEBS Letters. 439(3):215-218.

Example 23: Functional Characterization of TpELO1 and TpELO3

The substrate specificity of TpELO1 could be determined after expression and the feeding of different fatty acids (FIG. 9). The substrates fed can be detected in large amounts in all of the transgenic yeasts. The transgenic yeasts demonstrated the synthesis of novel fatty acids, the products of the TpElo1 reaction. This means that the gene TpElo1 has been expressed functionally.

It can be seen from Table 10 that TpElo1 shows a narrow substrate specificity. TpElo1 was only capable of elongating the C20-fatty acids eicosapentaenoic acid and arachidonic acid, but preferred the ω3-desaturated eicosapentaenoic acid.

The yeasts which had been transformed with the vector pYES2-TpELO1 were cultured in minimal medium in the presence of the fatty acids detailed. The fatty acid methyl esters were synthesized by subjecting intact cells to acid methanolysis. Thereafter, the FAMEs were analyzed via GLC.

TABLE 10

Expression of TpELO1 in yeast. Columns 1 and 3 show the control reactions for columns 2 (fed: 250 μm 20:4 Δ5,8, 11,14) and 4 (fed: 250 μm 20:4 Δ5,8,11,14,17).

| Fatty acids | Expression 1 | Expression 2 | Expression 3 | Expression 4 |
|---|---|---|---|---|
| 16:0 | 18.8 | 17.8 | 25.4 | 25.2 |
| 16:1$^{Δ9}$ | 28.0 | 29.8 | 36.6 | 36.6 |
| 18:0 | 5.2 | 5.0 | 6.8 | 6.9 |
| 18:1$^{Δ9}$ | 25.5 | 23.6 | 24.6 | 23.9 |
| 20:4$^{Δ5,8,11,14}$ | 22.5 | 23.4 | — | — |
| 22:4$^{Δ7,10,13,16}$ | — | 0.4 | — | — |
| 20:5$^{Δ5,8,11,14,17}$ | — | — | 6.6 | 6.5 |
| 22:5$^{Δ7,10,13,16,19}$ | — | — | — | 0.9 |
| % conversion | 0 | 1.7 | 0 | 12.2 |

The substrate specificity of TpElo3 could be determined after expression and the feeding of different fatty acids (FIG. 10). The substrates fed can be detected in large amounts in all of the transgenic yeasts. The transgenic yeasts demonstrated the synthesis of novel fatty acids, the products of the TpElo3 reaction. This means that the gene TpElo3 has been expressed functionally.

It can be seen from Table 11 that TpElo3 shows a narrow substrate specificity. TpElo3 was only capable of elongating the C18-fatty acid γ-linolenic acid and stearidonic acid, but preferred the ω3-desaturated stearidonic acid.

The yeasts which had been transformed with the vector pYES2-TpELO3 were cultured in minimal medium in the presence of the fatty acids detailed. The fatty acid methyl esters were synthesized by subjecting intact cells to acid methanolysis. Thereafter, the FAMEs were analyzed via GLC.

TABLE 11

Expression of TpELO3 in yeast. Column 1 shows the fatty acid profile of yeast without feeding. Column 2 shows the control reaction. In columns 3 to 6, the following were fed: γ-linolenic acid, stearidonic acid, arachidonic acid and eicosapentaenoic acid (250 μm of each fatty acid).

| Fatty acids | 1 | 2 | 3 | 4 | 5 | 6 |
|---|---|---|---|---|---|---|
| 16:0 | 17.9 | 20.6 | 17.8 | 16.7 | 18.8 | 18.8 |
| 16:1$^{Δ9}$ | 41.7 | 18.7 | 27.0 | 33.2 | 24.0 | 31.3 |
| 18:0 | 7.0 | 7.7 | 6.4 | 6.6 | 5.2 | 6.0 |
| 18:1$^{Δ9}$ | 33.3 | 16.8 | 24.2 | 31.8 | 25.5 | 26.4 |
| 18:2$^{Δ9,12}$ | — | 36.1 | — | — | — | — |
| 18:3$^{Δ6,9,12}$ | — | — | 6.1 | — | — | — |
| 18:4$^{Δ6,9,12,15}$ | — | — | — | 1.7 | — | — |
| 20:2$^{Δ11,14}$ | — | 0 | — | — | — | — |
| 20:3$^{Δ8,11,14}$ | — | — | 18.5 | — | — | — |
| 20:4$^{Δ8,11,14,17}$ | — | — | — | 10.0 | — | — |
| 20:4$^{Δ5,8,11,14}$ | — | — | — | — | 22.5 | — |
| 22:4$^{Δ7,10,13,16}$ | — | — | — | — | 0 | — |
| 20:5$^{Δ5,8,11,14,17}$ | — | — | — | — | — | 17.4 |
| 22:5$^{Δ7,10,13,16,19}$ | — | — | — | — | — | 0 |
| % conversion | 0 | 0 | 75 | 85 | 0 | 0 |

Example 24: Cloning and Expression Plasmid for the Heterologous Expression of the Pi-omega3Des in Yeasts For the heterologous expression in yeasts, the Pi-omega3Des clone was cloned into the yeast expression vector pYES3 via PCR, using suitable Pi-omega3Des-specific primers. Here, exclusively the open reading frame, of the gene, which encodes the Pi-omega3Des protein was amplified and provided with two cleavage sites for cloning into the pYES3 expression vector:

```
Forward Primer:
                              (SEQ ID NO: 149)
5'-TAAGCTTACATGGCGACGAAGGAGG Reverse Primer:
                              (SEQ ID NO: 150)
5'-TGGATCCACTTACGTGGACTTGGT
```

Composition of the PCR Mix (50 μl):
5.00 μl template cDNA
5.00 μl 10× buffer (Advantage polymerase)+25 mM MgCl$_2$
5.00 μl 2 mM dNTP
1.25 μl of each primer (10 pmol/μl of the 5'ATG primer and the 3' Stopp primer)
0.50 μl Advantage polymerase
The Advantage polymerase from Clontech was employed.
PCR Reaction Conditions:
Annealing temperature: 1 min 55° C.
Denaturation temperature: 1 min 94° C.
Elongation temperature: 2 min 72° C.
Number of cycles: 35

The PCR product was incubated with the restriction enzymes HindIII and BamHI for 2 hours at 37° C. The yeast expression vector pYES3 (Invitrogen) was incubated in the same manner. Thereafter, the 1104 bp PCR product and the vector were separated by agarose gel electrophoresis and the corresponding DNA fragments were excised. The DNA was purified by means of the Qiagen Gel Purification Kit following the manufacturer's instructions. Thereafter, vector and desaturase cDNA were ligated. The Rapid Ligation Kit from Roche was used for this purpose. The resulting plasmid pYES3-Pi-omega3Des was verified by sequencing and transformed into the *Saccharomyces* strain INVSc1 (Invitrogen) by means of electroporation (1500 V). pYES3 was transformed in parallel to act as a control. Thereafter, the yeasts were plated onto complete minimal dropout tryptophan medium supplemented with 2% glucose. Cells which were capable of growing in the medium without tryptophan thus comprise the relevant plasmids pYES3, pYES3-Pi-omega3Des. Following selection, in each case two transformants were selected for the further functional expression.

Example 25: Cloning Expression Plasmids for the Seed Specific Expression in Plants A further transformation vector based on pSUN-USP was generated for the transformation of plants. To this end, NotI cleavage sites were introduced at the 5' and 3' termini of the coding sequence, using the following primer pair
PSUN-Pi-omega3Des

```
Reverse:
                              (SEQ ID NO: 147)
3'-GCGGCCGCTTACGTGGACTTGGTC Forward:
                              (SEQ ID NO: 148)
5'-GCGGCCGCatGGCGACGAAGGAGG
```

Composition of the PCR Mix (50 μl):
5.00 μl template cDNA
5.00 μl 10× buffer (Advantage polymerase)+25 mM MgCl$_2$
5.00 μl 2 mM dNTP 1.25 µl of each primer (10 pmol/µl)
0.50 µl Advantage polymerase
The Advantage polymerase from Clontech was employed.
PCR Reaction Conditions:
Annealing temperature: 1 min 55° C.
Denaturation temperature: 1 min 94° C.
Elongation temperature: 2 min 72° C.
Number of cycles: 35

The PCR products were incubated with the restriction enzyme NotI for 4 hours at 37° C. The plant expression vector pSUN300-USP was incubated in the same manner. Thereafter, the PCR products and the 7624 bp vector were separated by agarose gel electrophoresis and the corresponding DNA fragments were excised. The DNA was purified by means of the Qiagen Gel Purification Kit following the manufacturer's instructions. Thereafter, vector and PCR products were ligated. The Rapid Ligation Kit from Roche was used for this purpose. The resulting plasmid pSUN-Piomega3Des was verified by sequencing.

Example 26: Expression of Pi-omega3Des in Yeasts

Yeasts which had been transformed with the plasmid pYES3 or pYES3-Pi-omega3Des, as described in Example 24, were analyzed as follows:

The yeast cells from the main cultures were harvested by centrifugation (100×g, 5 min, 20° C.) and washed with 100 mM NaHCO$_3$, pH 8.0 in order to remove residual medium and fatty acids. Fatty acid methyl esters (FAMEs) were prepared from the yeast cell sediments by acid methanolysis. To this end, the cell sediments were incubated for 1 hour at 80° C. with 2 ml of 1 N methanolic sulfuric acid and 2% (v/v) dimethoxypropane. The FAMEs were extracted by twice extracting with petroleum ether (PE). To remove nonderivatized fatty acids, the organic phases were washed in each case once with 2 ml of 100 mM NaHCO$_3$, pH 8.0, and 2 ml of distilled water. Thereafter, the PE phases were dried with Na$_2$SO$_4$, evaporated under argon and taken up in 100 µl of PE. The samples were separated on a DB-23 capillary column (30 m, 0.25 mm, 0.25 µm, Agilent) in a Hewlett-Packard 6850 gas chromatograph with flame ionization detector. The conditions for the GLC analysis were as follows: the oven temperature was programmed from 50° C. to 250° C. with an increment of 5° C./min and finally 10 minutes at 250° C. (holding).

The signals were identified by comparing the retention times with corresponding fatty acid standards (Sigma). The methodology is described for example in Napier and Michaelson, 2001, Lipids 36(8):761-766; Sayanova et al., 2001, Journal of Experimental Botany, 52(360):1581-1585, Sperling et al., 2001, Arch. Biochem. Biophys. 388(2):293-298 and Michaelson et al., 1998, FEBS Letters. 439(3):215-218.

Example 23: Functional Characterization of Pi-omega3Des

The substrate specificity of Pi-omega3Des could be determined after expression and the feeding of different fatty acids (FIGS. 12 to 18). The substrates fed are present in large amounts in all of the transgenic yeasts, which proves that these fatty acids have been taken up into the yeasts. The transgenic yeasts demonstrate the synthesis of novel fatty acids, the products of the Pi-omega3Des reaction. This means that the gene Pi-omega3Des has been expressed functionally.

FIG. 12 represents the desaturation of linoleic acid (18:2 ω6-fatty acid) to give α-linolenic acid (18:3 ω3-fatty acid) by Pi-omega3Des. The fatty acid methyl esters were synthesized by subjecting intact cells which had been transformed with the blank vector pYES2 (FIG. 12 A) or the vector pYES3-Pi-omega3Des (FIG. 12 B) to acid methanolysis. The yeasts were cultured in minimal medium in the presence of 18:2$^{\Delta 9,12}$-fatty acid (300 µm). Thereafter, the FAMEs were analyzed via GLC.

FIG. 13 represents the desaturation of γ-linolenic acid (18:3 ω6-fatty acid) to give stearidonic acid (18:4 ω3-fatty acid) by Pi-omega3Des. The fatty acid methyl esters were synthesized by subjecting intact cells which had been transformed with the blank vector pYES2 (FIG. 13 A) or the vector pYes3-Pi-omega3Des (FIG. 13 B) to acid methanolysis. The yeasts were cultured in minimal medium in the presence of γ-C18:3$^{\Delta 6,9,12}$-fatty acid (300 µm). Thereafter, the FAMEs were analyzed via GLC.

FIG. 14 represents the desaturation of C20:2-ω6-fatty acid to give C20:3-ω3-fatty acid by Pi-omega3Des. The fatty acid methyl esters were synthesized by subjecting intact cells which had been transformed with the blank vector pYES2 (FIG. 14 A) or the vector pYes3-Pi-omega3Des (FIG. 14 B) to acid methanolysis. The yeasts were cultured in minimal medium in the presence of C20:2$^{\Delta 11,14}$-fatty acid (300 µm). Thereafter, the FAMEs were analyzed via GLC.

FIG. 15 represents the desaturation of C20:3-ω6-fatty acid to give C20:4-ω3-fatty acid by Pi-omega3Des. The fatty acid methyl esters were synthesized by subjecting intact cells which had been transformed with the blank vector pYES2 (FIG. 15 A) or the vector pYes3-Pi-omega3Des (FIG. 15 B) to acid methanolysis. The yeasts were cultured in minimal medium in the presence of C20:3$^{\Delta 8,11,14}$-fatty acid (300 µm). Thereafter, the FAMEs were analyzed via GLC.

FIG. 16 shows the desaturation of arachidonic acid (C20:4-ω6-fatty acid) to give eicosapentaenoic acid (C20:5-ω3-fatty acid) by Pi-omega3Des.

The fatty acid methyl esters were synthesized by subjecting intact cells which had been transformed with the blank vector pYES2 (FIG. 16 A) or the vector pYes3-Pi-omega3Des (FIG. 16 B) to acid methanolysis. The yeasts were cultured in minimal medium in the presence of C20:4$^{\Delta 5,8,11,14}$-fatty acid (300 µm). Thereafter, the FAMEs were analyzed via GLC.

FIG. 17 represents the desaturation of docosatetraenoic acid (C22:4-ω6-fatty acid) to give docosapentaenoic acid (C22:5-ω3-fatty acid) by Pi-omega3Des. The fatty acid methyl esters were synthesized by subjecting intact cells which had been transformed with the blank vector pYES2 (FIG. 17 A) or the vector pYes3-Pi-omega3Des (FIG. 17 B) to acid methanolysis. The yeasts were cultured in minimal medium in the presence of C22:4$^{\Delta 7,10,13,16}$-fatty acid (300 µm). Thereafter, the FAMEs were analyzed via GLC.

The substrate specificity of Pi-omega3Des with regard to different fatty acids can be seen from FIG. 18. The yeasts which had been transformed with the vector pYes3-Pi-omega3Des were cultured in minimal medium in the presence of the fatty acids detailed. The fatty acid methyl esters were synthesized by subjecting intact cells to acid methanolysis. Thereafter, the FAMEs were analyzed via GLC. Each value represents a mean of three measurements. The conversion rates (% desaturation) were calculated using the formula:

[product]/[product]+[substrate]*100.

As described in Example 9, Pi-omega3Des can also be used for generating transgenic plants. Then, the lipids can be extracted from the seeds of these plants as described under Example 6.

Example 28: Cloning Desaturase Genes from *Ostreococcus tauri*

The search for conserved regions in the protein sequences with the aid of conserved motifs (His boxes, Domergue et al. 2002, Eur. J. Biochem. 269, 4105-4113) allowed the identification of five sequences with corresponding motifs in an *Ostreococcus tauri* sequence database (genomic sequences). The sequences were the following:

| Name of gene | SEQ ID | Amino acids | Homology |
| --- | --- | --- | --- |
| OtD4 | SEQ ID NO: 95 | 536 | Δ4-desaturase |
| OtD5.1 | SEQ ID NO: 91 | 201 | Δ5-desaturase |
| OtD5.2 | SEQ ID NO: 93 | 237 | Δ5-desaturase |
| OtD6.1 | SEQ ID NO: 89 | 456 | Δ6-desaturase |
| OtFad2 | SEQ ID NO: 107 | 361 | Δ12-desaturase |

The alignments for finding homologies of the individual genes were carried out using the tBLASTn algorithm (Altschul et al., J. Mol. Biol. 1990, 215: 403-410).

The cloning procedure was as follows:

40 ml of an *Ostreococcus tauri* culture in the stationary phase were spun down, resuspended in 100 µl of double-distilled water and stored at −20° C. The respective genomic DNAs were amplified on the basis of the PCR process. The relevant primer pairs were selected in such a way that they bore the yeast consensus sequence for highly efficient translation (Kozak, Cell 1986, 44:283-292) next to the start codon. The amplification of the OtDes DNAs was carried out in each case using 1 µl of defrosted cells, 200 µm of dNTPs, 2.5 U Taq polymerase and 100 pmol of each primer in a total volume of 50 µl. The PCR conditions were as follows: first denaturation for 5 minutes at 95° C., followed by 30 cycles of 30 seconds at 94° C., 1 minute at 55° C. and 2 minutes at 72° C., and a last elongation step of 10 minutes at 72° C.

The following primers were employed in the PCR:

```
OtDes6.1 Forward:
                                    (SEQ ID NO: 145)
5'ggtaccacataatgtgcgtggagacggaaaataacg3'

OtDes6.1 Reverse:
                                    (SEQ ID NO: 146)
5'ctcgagttacgccgtctttccggagtgttggcc3'
```

Example 29: Cloning Expression Plasmids for the Heterologous Expression in Yeasts To characterize the function of the desaturase OtDes6.1 (=Δ6-desaturase) from *Ostreococcus tauri*, the open reading frame of the DNA was cloned downstream of the galactose-inducible GAL1 promoter of pYES2.1/V5-His-TOPO (Invitrogen), giving rise to the corresponding clone pYES2.1-OtDes6.1. Further desaturase genes from *Ostreococcus* can be cloned analogously.

The *Saccharomyces cerevisiae* strain 334 was transformed by electroporation (1500 v) with the vector pYES2.1-OtDes6.1. A yeast which was transformed with the blank vector pYES2 was used as the control. The transformed yeasts were selected on complete minimal dropout uracil medium (CMdum) agar plates supplemented with 2% glucose. After the selection, in each case three transformants were selected for the further functional expression.

To express the OtDes6.1 desaturase, precultures of in each case 5 ml of dropout uracil CMdum liquid medium supplemented with 2% (w/v) raffinose were inoculated with the selected transformants and incubated for 2 days at 30° C., 200 rpm. 5 ml of CMdum liquid medium (without uracil) supplemented with 2% raffinose and 300 µm of various fatty acids were then inoculated with the precultures to an $OD_{600}$ of 0.05. Expression was induced by addition of 2% (w/v) galactose. The cultures were incubated for a further 96 hours at 20° C.

Example 30: Cloning of Expression Plasmids for the Seed-Specific Expression in Plants A further transformation vector based on pSUN-USP is generated for the transformation of plants. To this end, NotI cleavage sites are introduced at the 5' and 3' termini of the coding sequences, using PCR. The corresponding primer sequences are derived from the 5' and 3' regions of the desaturases.

Composition of the PCR Mix (50 µl):
5.00 µl template cDNA
5.00 µl 10× buffer (Advantage polymerase)+25 mM $MgCl_2$
5.00 µl 2 mM dNTP
1.25 µl of each primer (10 pmol/µl)
0.50 µl Advantage polymerase
The Advantage polymerase from Clontech was employed.
PCR Reaction Conditions:
Annealing temperature: 1 min 55° C.
Denaturation temperature: 1 min 94° C.
Elongation temperature: 2 min 72° C.
Number of cycles: 35

The PCR products were incubated with the restriction enzyme NotI for 16 hours at 37° C. The plant expression vector pSUN300-USP was incubated in the same manner. Thereafter, the PCR products and the vector were separated by agarose gel electrophoresis and the corresponding DNA fragments were excised. The DNA was purified by means of the Qiagen Gel Purification Kit following the manufacturer's instructions. Thereafter, vector and PCR products were ligated. The Rapid Ligation Kit from Roche was used for this purpose. The resulting plasmids were verified by sequencing.

pSUN300 is a derivative of plasmid pPZP (Hajdukiewicz, P, Svab, Z, Maliga, P., (1994) The small versatile pPZP family of *Agrobacterium* binary vectors for plant transformation. Plant Mol Biol 25:989-994). pSUN-USP originated from pSUN300, by inserting a USP promoter into pSUN300 in the form of an EcoRI fragment. The polyadenylation signal is that of the *Ostreococcus* gene from the *A. tumefaciens* Ti plasmid (ocs-Terminator, Genbank Accession V00088) (De Greve, H., Dhaese, P., Seurinck, J., Lemmers, M., Van Montagu, M. and Schell, J. Nucleotide sequence and transcript map of the *Agrobacterium tumefaciens* Ti plasmid-encoded octopine synthase gene J. Mol. Appl. Genet. 1 (6), 499-511 (1982)). The USP promoter corresponds to nucleotides 1 to 684 (Genbank Accession X56240), where part of the noncoding region of the USP gene is present in the promoter. The promoter fragment which is 684 base pairs in size was amplified by a PCR reaction and standard methods with the aid of a synthesized primer and by means of a commercially available T7 standard primer (Stratagene). (Primer sequence: 5'-GTCGAC-CCGCGGACTAGTGGGCCCTCTAGAC-CCGGGGGATCCGGATCTGCTGGCTATGAA-3', SEQ ID NO: 144).

The PCR fragment was recut with EcoRI/SalI and inserted into the vector pSUN300 with OCS terminator. This gave rise to the plasmid with the name pSUN-USP. The construct was used for the transformation of *Arabidopsis thaliana*, oilseed rape, tobacco and linseed.

Example 31: Expression of OtDes6.1 in Yeasts

Yeasts which had been transformed with the plasmids pYES2, pYES2-OtDes6.2 as described in Example 4 were analyzed as follows:

The yeast cells from the main cultures were harvested by centrifugation (100×g, 5 min, 20° C.) and washed with 100 mM $NaHCO_3$, pH 8.0 to remove residual medium and fatty acids. Starting with the yeast cell sediments, fatty acid methyl esters (FAMEs) were prepared by acid methanolysis. To this end, the cell sediments were incubated for one hour at 80° C. together with 2 ml of 1 N methanolic sulfuric acid and 2% (v/v) of dimethoxypropane. The FAMEs were extracted twice with petroleum ether (PE). To remove non-derivatized fatty acids, the organic phases were washed in each case once with 2 ml of 100 mM $NaHCO_3$, pH 8.0 and 2 ml of distilled water. Thereafter, the PE phases were dried with $Na_2SO_4$, evaporated under argon and taken up in 100 µl of PE. The samples were separated on a DB-23 capillary column (30 m, 0.25 mm, 0.25 µm, Agilent) in a Hewlett-Packard 6850 gas chromatograph equipped with flame ionization detector. The conditions for the GLC analysis were as follows: the oven temperature was programmed from 50° C. to 250° C. with an increment of 5° C./min and finally 10 min at 250° C. (holding).

The signals were identified by comparing the retention times with corresponding fatty acid standards (Sigma). The methodology is described for example in Napier and Michaelson, 2001, Lipids. 36(8):761-766; Sayanova et al., 2001, Journal of Experimental Botany. 52(360):1581-1585, Sperling et al., 2001, Arch. Biochem. Biophys. 388(2):293-298 and Michaelson et al., 1998, FEBS Letters. 439(3):215-218.

Example 32: Functional Characterization of Desaturases from *Ostreococcus*

The substrate specificity of desaturases can be determined after expression in yeast (see examples Cloning desaturase genes, Yeast expression) by feeding by means of different yeasts. Descriptions for determining the individual activities are found in WO 93/11245 for Δ15-desaturases, WO 94/11516 for Δ12-desaturases, WO 93/06712, U.S. Pat. No. 5,614,393, U.S. Pat. No. 5,614,393, WO 96/21022, WO 0021557 and WO 99/27111 for Δ6-desaturases, Qiu et al. 2001, J. Biol. Chem. 276, 31561-31566 for Δ4-desaturases, Hong et al. 2002, Lipids 37, 863-868 for Δ5-desaturases.

Table 12 represents the substrate specificity of the desaturase OtDes6.1 with regard to different fatty acids. The substrate specificity of OtDes6.1 was determined after expression and feeding of various fatty acids. The substrates which have been fed can be detected in large amounts in all of the transgenic yeasts. The transgenic yeasts demonstrated the synthesis of novel fatty acids, the products of the OtDes6.2 reaction (FIG. 20). This means that the gene OtDes6.1 has been expressed functionally.

The yeasts which had been transformed with the vector pYES2-OtDes6.1 were cultured in minimal medium in the presence of the fatty acids detailed. The fatty acid methyl esters were synthesized by subjecting intact cells to acid methanolysis. Thereafter, the FAMEs were analyzed via GLC. Each value represents the mean (n=3)±standard deviation. The activity corresponds to the conversion rate calculated using the formula [substrate/(substrate+product)*100].

It can be seen from Table 12 that OtDes6.1 shows substrate specificity for linoleic and linolenic acid (18:2 and 18:3) since the highest activities are obtained with these fatty acids. In contrast, the activity for oleic acid (18:1) and palmitoleic acid (16:1) is markedly lower. The preferred conversion of linoleic and linolenic acid demonstrates that this desaturase is suitable for the production of polyunsaturated fatty acids.

| Substrates | Activity in % |
|---|---|
| $16:1^{\Delta 9}$ | 5.6 |
| $18:1^{\Delta 9}$ | 13.1 |
| $18:2^{\Delta 9,12}$ | 68.7 |
| $18:3^{\Delta 9,12,15}$ | 64.6 |

FIG. 20 shows the conversion of linoleic acid by OtDes6.1. The FAMEs were analyzed via gas chromatography. The substrate which has been fed (C18:2) is converted into γ-C18:3. Both the starting material and the resulting product are indicated by arrows.

FIG. 21 represents the conversion of linoleic acid (=LA) and α-linolenic acid (=ALA) in the presence of OtDes6.1 to give γ-linolenic acid (=GLA) and stearidonic acid (=STA), respectively (FIGS. 21A and C). Moreover, FIG. 21 shows the conversion of linoleic acid (=LA) and α-linolenic acid (=ALA) in the presence of the Δ6-desaturase OtDes6.1 together with the *Physcomitrella patens* Δ6-elongase PSE1 (Zank et al. 2002, Plant J. 31:255-268) and the *Phaeodactylum tricornutum* Δ5-desaturase PtD5 (Domergue et al. 2002, Eur. J. Biochem. 269, 4105-4113) to give dihomo-γ-linolenic acid (=DHGLA) and arachidonic acid (=ARA, FIG. 21 B) and dihomostearidonic acid (=DHSTA) and eicosapentaenoic acid (=EPA, FIG. 21 D), respectively. FIG. 21 shows clearly that the reaction products GLA and STA of the Δ6-desaturase OtDes6.1 in the presence of the Δ6-elongase PSE1 is elongated virtually quantitatively to give DHGLA and DHSTA, respectively. The subsequent desaturation by the Δ5-desaturase PtD5 to give ARA and EPA, respectively, also proceeds smoothly. Approximately 25-30% of the elongase product is desaturated (FIGS. 21B and D).

TABLE 13 which follows gives an overview of the *Ostreococcus* desaturases which have been cloned:

*Ostreococcus tauri* desaturases

| Name | bp | aa | Homology | Cyt. B5 | His box1 | His box2 | His box3 |
|---|---|---|---|---|---|---|---|
| OtD4 | 1611 | 536 | Δ4-desaturase | HPGG (SEQ ID NO: 227) | HCANH (SEQ ID NO: 228) | WRYHHQVSHH (SEQ ID NO: 231) | QVEHHLFP (SEQ ID NO: 235) |

TABLE 13-continued which follows gives an overview of the
*Ostreococcus desaturases*
which have been cloned:
*Ostreococcus tauri* desaturases

| Name | bp | aa | Homology | Cyt. B5 | His box1 | His box2 | His box3 |
|---|---|---|---|---|---|---|---|
| OtD5.1 | 606 | 201 | Δ5-desaturase | — | — | — | QVVHHLFP (SEQ ID NO: 236) |
| OtD5.2 | 714 | 237 | Δ5-desaturase | — | — | WRYHHMVSHH (SEQ ID NO: 232) | QIEHHLPF (SEQ ID NO: 237) |
| OtD6.1 | 1443 | 480 | Δ6-desaturase | HPGG (SEQ ID NO: 227) | HEGGH (SEQ ID NO: 229) | WNSMHNKHH (SEQ ID NO: 233) | QVIHHLFP (SEQ ID NO: 238) |
| OtFAD2 | 1086 | 361 | Δ12-desaturase | — | HECGH (SEQ ID NO: 230) | WQRSHAVHH (SEQ ID NO: 234) | HVAHH (SEQ ID NO: 239) |

Example 33: Cloning Desaturase Genes from *Thalassiosira pseudonana*

The search for conserved regions in the protein sequences with the aid of conserved motifs (His boxes, see motifs) allowed the identification of six sequences with corresponding motifs in an *Thalassiosira pseudonana* sequence database (genomic sequences). The sequences were the following:

| Name of gene | SEQ ID | Amino acids | Homology |
|---|---|---|---|
| TpD4 | SEQ ID NO: 103 | 503 | Δ4-desaturase |
| TpD5-1 | SEQ ID NO: 99 | 476 | Δ5-desaturase |
| TpD5-2 | SEQ ID NO: 101 | 482 | Δ5-desaturase |
| TpD6 | SEQ ID NO: 97 | 484 | Δ6-desaturase |
| TpFAD2 | SEQ ID NO: 109 | 434 | Δ12-desaturase |
| TpO3 | SEQ ID NO: 105 | 418 | ω3-desaturase |

The cloning procedure was as follows:

40 ml of an *Thalassiosira pseudonana* culture in the stationary phase were spun down, resuspended in 100 µl of double-distilled water and stored at −20° C. The respective genomic DNAs were amplified on the basis of the PCR method. The relevant primer pairs were selected in such a way that they bore the yeast consensus sequence for highly efficient translation (Kozak, Cell 1986, 44:283-292) next to the start codon. The amplification of the TpDes DNAs was carried out in each case using 1 µl of defrosted cells, 200 µm of dNTPs, 2.5 U Taq polymerase and 100 pmol of each primer in a total volume of 50 µl. The PCR conditions were as follows: first denaturation for 5 minutes at 95° C., followed by 30 cycles of 30 seconds at 94° C., 1 minute at 55° C. and 2 minutes at 72° C., and a last elongation step of 10 minutes at 72° C.

Example 34: Cloning Expression Plasmids for the Heterologous Expression in Yeasts To characterize the function of the desaturases from *Thalassiosira pseudonana*, the open reading frame of the respective DNA was cloned downstream of the galactose-inducible GAL1 promoter of pYES2.1/V5-His-TOPO (Invitrogen), giving rise to the corresponding pYES2.1 clone.

The *Saccharomyces cerevisiae* strain 334 is transformed by electroporation (1500 v) with the vectors pYES2.1-TpDesaturasen. A yeast which is transformed with the blank vector pYES2 is used as the control. The transformed yeasts are selected on complete minimal dropout uracil medium (CMdum) agar plates supplemented with 2% glucose. After the selection, in each case three transformants are selected for the further functional expression.

To express the Tp desaturases, initially precultures of in each case 5 ml of dropout uracil CMdum liquid medium supplemented with 2% (w/v) raffinose are inoculated with the selected transformants and incubated for 2 days at 30° C., 200 rpm. 5 ml of liquid CMdum medium (without uracil) supplemented with 2% raffinose and 300 µm of various fatty acids are then inoculated with the precultures to an $OD_{600}$ of 0.05. The expression is induced by addition of 2% (w/v) galactose. The cultures are incubated for a further 96 hours at 20° C.

Example 35: Cloning of Expression Plasmids for the Seed-Specific Expression in Plants A further transformation vector based on pSUN-USP is generated for the transformation of plants. To this end, NotI cleavage sites are introduced at the 5' and 3' termini of the coding sequences, using PCR. The corresponding primer sequences are derived from the 5' and 3' regions of the desaturases.

Composition of the PCR Mix (50 µl):
5.00 µl template cDNA
5.00 µl 10× buffer (Advantage polymerase)+25 mM $MgCl_2$
5.00 µl 2 mM dNTP
1.25 µl of each primer (10 pmol/µl)
0.50 µl Advantage polymerase
The Advantage polymerase from Clontech was employed.
PCR Reaction Conditions:
Annealing temperature: 1 min 55° C.
Denaturation temperature: 1 min 94° C.
Elongation temperature: 2 min 72° C.
Number of cycles: 35

The PCR products are incubated with the restriction enzyme NotI for 16 hours at 37° C. The plant expression vector pSUN300-USP is incubated in the same manner.

Thereafter, the PCR products and the vector are separated by agarose gel electrophoresis and the corresponding DNA fragments are excised. The DNA was purified by means of the Qiagen Gel Purification Kit following the manufacturer's instructions. Thereafter, vector and PCR products are ligated. The Rapid Ligation Kit from Roche was used for this purpose. The resulting plasmids are verified by sequencing.

pSUN300 is a derivative of plasmid pPZP (Hajdukiewicz, P, Svab, Z, Maliga, P., (1994) The small versatile pPZP family of *Agrobacterium* binary vectors for plant transformation. Plant Mol Biol 25:989-994). pSUN-USP originated from pSUN300, by inserting a USP promoter into pSUN300 in the form of an EcoRI fragment. The polyadenylation signal is the OCS gene from the *A. tumefaciens* Ti plasmid (ocs-Terminator, Genbank Accession V00088) (De Greve, H., Dhaese, P., Seurinck, J., Lemmers, M., Van Montagu, M. and Schell, J. Nucleotide sequence and transcript map of the *Agrobacterium tumefaciens* Ti plasmid-encoded octopine synthase gene J. Mol. Appl. Genet. 1 (6), 499-511 (1982)). The USP promoter corresponds to nucleotides 1 to 684 (Genbank Accession X56240), where part of the noncoding region of the USP gene is present in the promoter. The promoter fragment which is 684 base pairs in size was amplified by a PCR reaction and standard methods with the aid of a synthesized primer and by means of a commercially available T7 standard primer (Stratagene).

```
(Primer sequence:
5'-GTCGACCCGCGGACTAGTGGGCCCTCTAGACCCGGGGATCC
GGATCTGCTGGCTATGAA-3', SEQ ID NO: 143).
```

The PCR fragment was recut with EcoRI/SalI and inserted into the vector pSUN300 with OCS terminator. This gave rise to the plasmid with the name pSUN-USP. The construct was used for the transformation of *Arabidopsis thaliana*, oilseed rape, tobacco and linseed.

Example 36: Expression of Tp Desaturases in Yeasts

Yeasts which have been transformed with the plasmids pYES2 and pYES2-TpDesaturasen as described in Example 4 were analyzed as follows:

The yeast cells from the main cultures are harvested by centrifugation (100×g, 5 min, 20° C.) and washed with 100 mM NaHCO₃, pH 8.0 to remove residual medium and fatty acids. Starting with the yeast cell sediments, fatty acid methyl esters (FAMEs) are prepared by acid methanolysis. To this end, the cell sediments are incubated for one hour at 80° C. together with 2 ml of 1 N methanolic sulfuric acid and 2% (v/v) of dimethoxypropane. The FAMEs were extracted twice with petroleum ether (PE). To remove nonderivatized fatty acids, the organic phases are washed in each case once with 2 ml of 100 mM NaHCO₃, pH 8.0 and 2 ml of distilled water. Thereafter, the PE phases are dried with Na₂SO₄, evaporated under argon and taken up in 100 µl of PE. The samples are separated on a DB-23 capillary column (30 m, 0.25 mm, 0.25 µm, Agilent) in a Hewlett-Packard 6850 gas chromatograph equipped with flame ionization detector. The conditions for the GLC analysis are as follows: the oven temperature is programmed from 50° C. to 250° C. with an increment of 5° C./min and finally 10 min at 250° C. (holding).

The signals are identified by comparing the retention times with corresponding fatty acid standards (Sigma). The methodology is described for example in Napier and Michaelson, 2001, Lipids. 36(8):761-766; Sayanova et al., 2001, Journal of Experimental Botany. 52(360):1581-1585, Sperling et al., 2001, Arch. Biochem. Biophys. 388(2):293-298 and Michaelson et al., 1998, FEBS Letters. 439(3):215-218.

Example 37: Functional Characterization of Desaturases from *Thalassiosira pseudonana*

The substrate specificity of desaturases can be determined after expression in yeast (see examples Cloning desaturase genes, Yeast expression) by feeding by means of different yeasts. Descriptions for determining the individual activities are found in WO 93/11245 for Δ15-desaturases, WO 94/11516 for Δ12-desaturases, WO 93/06712, U.S. Pat. No. 5,614,393, U.S. Pat. No. 5,614,393, WO 96/21022, WO 0021557 and WO 99/27111 for Δ6-desaturases, Qiu et al. 2001, J. Biol. Chem. 276, 31561-31566 for Δ4-desaturases, Hong et al. 2002, Lipids 37, 863-868 for Δ5-desaturases.

The activity of the individual desaturases is calculated from the conversion rate using the formula [substrate/(substrate+product)*100]

Tables 11 and 12 which follow give an overview of the cloned *Thalassiosira pseudonana* desaturases.

TABLE 14

Length and characteristic features of the cloned *Thalassiosira pseudonana* desaturases

| Desaturase | cDNA (bp) | Protein (aa) | Cyt. B5 | His box1 | His box2 | His box3 |
|---|---|---|---|---|---|---|
| TpD4 | 1512 | 503 | HPGG (SEQ ID NO: 227) | HDGNH (SEQ ID NO: 240) | WELQHMLGHH (SEQ ID NO: 244) | QIEHHLFP (SEQ ID NO: 250) |
| TpD5-1 | 1431 | 476 | HPGG (SEQ ID NO: 227) | HDANH (SEQ ID NO: 241) | WMAQHWTHH (SEQ ID NO: 245) | QVEHHLFP (SEQ ID NO: 235) |
| TpD5-2 | 1443 | 482 | HPGG (SEQ ID NO: 227) | HDANH (SEQ ID NO: 241) | WLAQHWTHH (SEQ ID NO: 246) | QVEHHLFP (SEQ ID NO: 235) |

TABLE 14-continued

Length and characteristic features of the
cloned *Thalassiosira pseudonana* desaturases

| Desaturase | cDNA (bp) | Protein (aa) | Cyt. B5 | His box1 | His box2 | His box3 |
|---|---|---|---|---|---|---|
| TpD6 | 1449 | 484 | HPGG (SEQ ID NO: 227) | HDFLH (SEQ ID NO: 242) | WKNKHNGHH (SEQ ID NO: 247) | QVDHHLFP (SEQ ID NO: 251) |
| TpFAD2 (d12) | 1305 | 434 | — | HECGH (SEQ ID NO: 230) | HAKHH (SEQ ID NO: 248) | HVAHHLFH (SEQ ID NO: 252) |
| TpO3 | 1257 | 419 | — | HDANH (SEQ ID NO: 243) | WLFMVTYLQHH (SEQ ID NO: 249) | HVVHHLF (SEQ ID NO: 253) |

TABLE 15

Length, exons, homology and identities of the cloned desaturases.

| Des. | GDNA (bp) | Exon 1 | Exon 2 | First Blast Hit | Hom./Iden. |
|---|---|---|---|---|---|
| TpD4 | 2633 | 496-1314 | 1571-2260 | Thrautochitrium D4-des | 56%/43% |
| TpD5-1 | 2630 | 490-800 | 900-2019 | Phaeodactylum D5-des | 74%/62% |
| TpD5-2 | 2643 | 532-765 | 854-2068 | Phaeodactylum D5-des | 72%/61% |
| TpD6 | 2371 | 379-480 | 630-1982 | Phaeodactylum D6-des | 83%/69% |
| TpFAD2 | 2667 | 728-2032 | — | Phaeodacrylum FAD2 | 76%/61% |
| TpO3 | 2402 | 403-988 | 1073-1743 | Chaenorhabdidis Fad2 | 49%/28% |

The Δ12-desaturase genes from *Ostreococcus* and *Thalassiosira* can also be cloned analogously to the above examples.

Example 38: Cloning Elongase Genes from *Xenopus laevis* and *Ciona intestinalis*

The search for conserved regions (see consensus sequences, SEQ ID NO: 115 and SEQ ID NO: 116) in the protein sequences in gene databases (Genbank) with the aid of the elongase genes with Δ5-elongase activity or Δ6-elongase activity, which are detailed in the application, allowed the identification and isolation of further elongase sequences from other organisms. Further sequences were identified in each case from *X. laevis* and from *C. intestinalis*, using suitable motifs. The sequences were the following:

| Name of gene | Organism | Genbank No. | SEQ ID NO: | Amino acids |
|---|---|---|---|---|
| ELO(XI) | *Xenopus laevis* | BC044967 | 117 | 303 |
| ELO(Ci) | *Ciona intestinalis* | AK112719 | 119 | 290 |

The cDNA clone of *X. laevis* was obtained from the NIH (National Institute of Health) [Genetic and genomic tools for *Xenopus* research: The NIH *Xenopus* initiative, Dev. Dyn. 225 (4), 384-391 (2002)].

The cDNA clone of *C. intestinalis* was obtained from the University of Kyoto [Satou, Y., Yamada, L., Mochizuki, Y., Takatori, N., Kawashima, T., Sasaki, A., Hamagu-chi, M., Awazu, S., Yagi, K., Sasakura, Y., Nakayama, A., Ishikawa, H., Inaba, K. and Satoh, N. "A cDNA resource from the basal chordate *Ciona intestinalis*" JOURNAL Genesis 33 (4), 153-154 (2002)].

Example 39: Cloning Expression Plasmids for the Heterologous Expression in Yeasts The elongase DNAs were amplified in each case using 1 µl of cDNA, 200 µM dNTPs, 2.5 U of Advantage polymerase and 100 pmol of each primer in a total volume of 50 µl. The PCR conditions were as follows: first denaturation for 5 minutes at 95° C., followed by 30 cycles of 30 seconds at 94° C., 1 minute at 55° C. and 2 minutes at 72° C., and a final elongation step of 10 minutes at 72° C.

To clone the sequence for heterologous expression in yeasts, the following oligonucleotides were used for the PCR reaction:

| Name of gene and SEQ ID NO: | | Primer sequence |
|---|---|---|
| ELO(XI) | SEQ ID NO: 121 | F: 5'-AGGATCC<u>ATG</u>GCCTT CAAGGAGCTCACATC |
| | SEQ ID NO: 122 | R: 5'-CCTCGAG<u>TCA</u>ATGGT TTTTGCTTTTCAATGCACCG |
| ELO(Ci) | SEQ ID NO: 123 | F: 5'-TAAGCTT<u>ATG</u>GACGT ACTTCATCGT |
| | SEQ ID NO: 124 | R: 5'-TCAGATC<u>TTT</u>AATCG GTTTTACCATT |

*F = forward primer, R = reverse primer

The PCR products were incubated for 30 minutes at 21° C. with the yeast expression vector pYES2.1-TOPO (Invitrogen) following the manufacturer's instructions. The PCR product is ligated into the vector by means of a T overhang and activity of a topoisomerase (Invitrogen). After incubation, *E. coli* DH5α cells were transformed. Suitable clones were identified by PCR, the plasmid DNA was isolated by means of Qiagen DNAeasy Kit and verified by sequencing. The correct sequence was then transformed into the *Saccharomyces* strain INVSc1 (Invitrogen) by electroporation (1500 V). As a control, the blank vector pYES2.1 was transformed in parallel. The yeasts were subsequently plated onto complete uracil dropout minimal medium supplemented with 2% glucose. Cells which were capable of growing in the medium without uracil thus comprise the corresponding plasmids pYES2.1, pYES2.1-ELO(XI) and pYES2.1-ELO(Ci). After the selection, in each case two transformants were selected for further functional expression.

Example 40: Cloning Expression Plasmids for the Seed-Specific Expression in Plants A further transformation vector based on pSUN-USP is generated for the transformation of plants. To this end, NotI cleavage sites are introduced at the 5' and 3' ends of the coding sequence, using the following primer pair:
pSUN-ELO(XI)

```
Forward:
                                    (SEQ ID NO: 125)
5'-GCGGCCGCACCATGGCCTTCAAGGAGCTCACATC Reverse:
                                    (SEQ ID NO: 126)
3'-GCGGCCGCCTTCAATGGTTTTTGCTTTTCAATGCACCG
``` pSUN-ELO(Ci)

```
Forward:
                                    (SEQ ID NO: 127)
5'-GCGGCCGCACCATGGACGTACTTCATCGT Reverse:
                                    (SEQ ID NO: 128)
3'-GCGGCCGCTTTAATCGGTTTTACCATT
```

Composition of the PCR Mix (50 µl):
5.00 µl template cDNA
5.00 µl 10× buffer (Advantage polymerase)+25 mM MgCl$_2$
5.00 µl 2 mM dNTP
1.25 µl of each primer (10 pmol/µl)
0.50 µl Advantage polymerase
The Advantage polymerase from Clontech was employed.
PCR Reaction Conditions:
Annealing temperature: 1 min 55° C.
Denaturation temperature: 1 min 94° C.
Elongation temperature: 2 min 72° C.
Number of cycles: 35

The PCR products were incubated with the restriction enzyme NotI for 16 hours at 37° C. The plant expression vector pSUN300-USP was incubated in the same manner. Thereafter, the PCR products and the 7624 bp vector were separated by agarose gel electrophoresis and the corresponding DNA fragments were excised. The DNA was purified by means of the Qiagen Gel Purification Kit following the manufacturer's instructions. Thereafter, vector and PCR products were ligated. The Rapid Ligation Kit from Roche was used for this purpose. The resulting plasmids pSUN-ELO(XI) and pSUN-ELO(Ci) were verified by sequencing.

pSUN300 is a derivative of plasmid pPZP (Hajdukiewicz, P, Svab, Z, Maliga, P., (1994) The small versatile pPZP family of *Agrobacterium* binary vectors for plant transformation. Plant Mol Biol 25:989-994). pSUN-USP originated from pSUN300, by inserting a USP promoter into pSUN300 in the form of an EcoRI fragment. The polyadenylation signal is that of the Octopine synthase gene from the *A. tumefaciens* Ti plasmid (ocs-Terminator, Genbank Accession V00088) (De Greve, H., Dhaese, P., Seurinck, J., Lemmers, M., Van Montagu, M. and Schell, J. Nucleotide sequence and transcript map of the *Agrobacterium tumefaciens* Ti plasmid-encoded octopine synthase gene J. Mol. Appl. Genet. 1 (6), 499-511 (1982)). The USP promoter corresponds to nucleotides 1 to 684 (Genbank Accession X56240), where part of the noncoding region of the USP gene is present in the promoter. The promoter fragment which is 684 base pairs in size was amplified by a PCR reaction and standard methods with the aid of a synthesized primer and by means of a commercially available T7 standard primer (Stratagene).

```
Primer sequence:
                                    (SEQ ID NO: 129)
5'-GTCGACCCGCGGACTAGTGGGCCCTCTAGACCCGGGGATCC
GGATCTGCTGGCTATGAA-3'.
```

The PCR fragment was recut with EcoRI/SalI and inserted into the vector pSUN300 with OCS terminator. This gave rise to the plasmid with the name pSUN-USP. The construct was used for the transformation of *Arabidopsis thaliana*, oilseed rape, tobacco and linseed.

Lipids were extracted from yeasts and seeds as described for Example 6.

Example 41: Expression of ELO(XI) and ELO(Ci) in Yeasts

Yeasts which had been transformed with the plasmids pYES2, pYES2-ELO(XI) and pYES2-ELO(Ci) as in Example 4 were analyzed as follows:

The yeast cells from the main cultures were harvested by centrifugation (100×g, 5 min, 20° C.) and washed with 100 mM NaHCO$_3$, pH 8.0 in order to remove residual medium and fatty acids. Fatty acid methyl esters (FAMEs) were prepared from the yeast cell sediments by acid methanolysis. To this end, the cell sediments were incubated for 1 hour at 80° C. with 2 ml of 1N methanolic sulfuric acid and 2% (v/v) dimethoxypropane. The FAMEs were extracted by twice extracting with petroleum ether (PE). To remove non-derivatized fatty acids, the organic phases were washed in each case once with 2 ml of 100 mM NaHCO$_3$, pH 8.0, and 2 ml of distilled water. Thereafter, the PE phases were dried with Na$_2$SO$_4$, evaporated under argon and taken up in 100 µl of PE. The samples were separated on a DB-23 capillary column (30 m, 0.25 mm, 0.25 µm, Agilent) in a Hewlett-Packard 6850 gas chromatograph with flame ionization detector. The conditions for the GLC analysis were as follows: the oven temperature was programmed from 50° C. to 250° C. with an increment of 5° C./min and finally 10 minutes at 250° C. (holding).

The signals were identified by comparing the retention times with corresponding fatty acid standards (Sigma). The methodology is described for example in Napier and Michaelson, 2001, Lipids 36(8):761-766; Sayanova et al., 2001, Journal of Experimental Botany, 52(360):1581-1585, Sperling et al., 2001, Arch. Biochem. Biophys. 388(2):293-298 and Michaelson et al., 1998, FEBS Letters. 439(3):215-218.

Example 42: Functional Characterization of ELO(XI) and ELO(Ci)

The substrate specificity of ELO(XI) can be determined after expression and the feeding of different fatty acids (FIG. 22). The substrates fed can be detected in large amounts in all of the transgenic yeasts. The transgenic yeasts demonstrated the synthesis of novel fatty acids, the products of the ELO(XI) reaction. This means that the gene ELO(XI) has been expressed functionally.

It can be seen from Table 16 that ELO(XI) shows a broad substrate specificity. Both C18- and C20-fatty acids are elongated, but a preference for Δ5- and Δ6-desaturated fatty acids can be observed.

The yeasts which had been transformed with the vector pYES2-ELO(XI) were cultured in minimal medium in the presence of the fatty acids detailed. The fatty acid methyl esters were synthesized by subjecting intact cells to acid methanolysis. Thereafter, the FAMEs were analyzed via GLC.

TABLE 16

Expression of ELO(XI) in yeast. The conversion rate of different starting materials (amounts fed: in each case 250 μM) is described.

| Starting materials | Conversion of the starting materials by ELO(XI) in % |
|---|---|
| 16:0 | 3 |
| 16:1$^{\Delta 9}$ | 0 |
| 18:0 | 2 |
| 18:1$^{\Delta 9}$ | 0 |
| 18:2$^{\Delta 9,12}$ | 3 |
| 18:3$^{\Delta 6,9,12}$ | 12 |
| 18:3$^{\Delta 5,9,12}$ | 13 |
| 18:3$^{\Delta 9,12,15}$ | 3 |
| 18:4$^{\Delta 6,9,12,15}$ | 20 |
| 20:3$^{\Delta 8,11,14}$ | 5 |
| 20:3$^{\Delta 11,14,17}$ | 13 |
| 20:4$^{\Delta 5,8,11,14}$ | 15 |
| 20:5$^{\Delta 5,8,11,14,17}$ | 10 |
| 22:4$^{\Delta 7,10,13,16}$ | 0 |
| 22:6$^{\Delta 4,7,10,13,16,19}$ | 0 |

The substrate specificity of ELO(Ci) can be determined after expression and the feeding of different fatty acids (FIG. 23). The substrates fed can be detected in large amounts in all of the transgenic yeasts. The transgenic yeasts demonstrated the synthesis of novel fatty acids, the products of the ELO(Ci) reaction. This means that the gene ELO(Ci) has been expressed functionally.

TABLE 17

Expression of ELO(Ci) in yeast. The conversion rate of different starting materials (amounts fed: in each case 250 μM) is described.

| Starting materials | Conversion of the starting materials by ELO(Ci) in % |
|---|---|
| 16:0 | 0 |
| 16:1$^{\Delta 9}$ | 0 |
| 18:0 | 0 |
| 18:1$^{\Delta 9}$ | 0 |
| 18:2$^{\Delta 9,12}$ | 23 |
| 18:3$^{\Delta 6,9,12}$ | 10 |
| 18:3$^{\Delta 5,9,12}$ | 38 |
| 18:3$^{\Delta 9,12,15}$ | 25 |
| 18:4$^{\Delta 6,9,12,15}$ | 3 |
| 20:3$^{\Delta 8,11,14}$ | 10 |
| 20:3$^{\Delta 11,14,17}$ | 8 |
| 20:4$^{\Delta 5,8,11,14}$ | 10 |
| 20:5$^{\Delta 5,8,11,14,17}$ | 15 |
| 22:4$^{\Delta 7,10,13,16}$ | 0 |
| 22:6$^{\Delta 4,7,10,13,16,19}$ | 0 |

It can be seen from Table 17 that ELO(Ci) shows a broad substrate specificity. Both C18- and C20-fatty acids are elongated, but a preference for Δ5- and Δ6-desaturated fatty acids can be observed.

The yeasts which had been transformed with the vector pYES2-ELO(Ci) were cultured in minimal medium in the presence of the fatty acids detailed. The fatty acid methyl esters were synthesized by subjecting intact cells to acid methanolysis. Thereafter, the FAMEs were analyzed via GLC.

Example 43: Cloning Genes from *Ostreococcus tauri*

The search for conserved regions in the protein sequences with the aid of the elongase genes with Δ5-elongase activity or Δ6-elongase activity, which have been described herein, allowed the identification of in each case two sequences with corresponding motifs in an *Ostreococcus tauri* sequence database (genomic sequences). The sequences were the following:

| Name of gene | SEQ ID | Amino acids |
|---|---|---|
| OtELO1, (Δ5-elongase) | SEQ ID NO: 67 | 300 |
| OtELO1.2, (Δ5-elongase) | SEQ ID NO: 113 | 300 |
| OtELO2, (Δ6-elongase) | SEQ ID NO: 69 | 292 |
| OtELO2.1, (Δ6-elongase) | SEQ ID NO: 111 | 292 |

OtElo1 and OtElo1.2 show the highest similarity with an elongase from *Danio rerio* (GenBank AAN77156; approximately 26% identity), while OtElo2 and OtElo2.1 show the highest similarity with *Physcomitrella* Elo (PSE) [approx. 36% identity] (alignments were carried out using the tBLASTn algorithm (Altschul et al., J. Mol. Biol. 1990, 215: 403-410)).

The elongases were cloned as follows:

40 ml of an *Ostreococcus tauri* culture in the stationary phase were spun down, resuspended in 100 μl of double-distilled water and stored at −20° C. The respective genomic DNAs were amplified on the basis of the PCR method. The relevant primer pairs were selected in such a way that they bore the yeast consensus sequence for highly efficient translation (Kozak, Cell 1986, 44:283-292) next to the start codon. The amplification of the OtElo DNAs was carried out in each case using 1 μl of defrosted cells, 200 μM of dNTPs, 2.5 U Taq polymerase and 100 pmol of each primer in a total volume of 50 μl. The PCR conditions were as follows: first denaturation for 5 minutes at 95° C., followed by 30 cycles of 30 seconds at 94° C., 1 minute at 55° C. and 2 minutes at 72° C., and a last elongation step of 10 minutes at 72° C.

Example 44: Cloning Expression Plasmids for the Heterologous Expression in Yeasts To characterize the function of the elongases from *Ostreococcus tauri*, the open reading frames of the respective DNAs were cloned downstream of the galactose-inducible GAL1 promoter of pYES2.1/V5-His-TOPO (Invitrogen), giving rise to pOTE1, pOTE1.2, pOTE2 and pOTE2.1.

The *Saccharomyces cerevisiae* strain 334 was transformed by electroporation (1500 V) with the vector pOTE1, pOTE1.2, pOTE2 and pOTE2.1, respectively. A yeast which was transformed with the blank vector pYES2 was used as the control. The transformed yeasts were selected on complete minimal dropout uracil medium (CMdum) agar plates supplemented with 2% glucose. After the selection, in each case three transformants were selected for the further functional expression.

To express the Ot elongases, precultures of in each case 5 ml of liquid CMdum medium supplemented with 2% (w/v) raffinose, but without uracil, were inoculated with the selected transformants and incubated for 2 days at 30° C., 200 rpm. 5 ml of liquid CMdum medium (without uracil) supplemented with 2% raffinose and 300 µm of various fatty acids were then inoculated with the precultures to an $OD_{600}$ of 0.05. The expression was induced by addition of 2% (w/v) galactose. The cultures were incubated for a further 96 hours at 20° C.

Example 45: Cloning of Expression Plasmids for the Seed-Specific Expression in Plants A further transformation vector based on pSUN-USP was generated for the transformation of plants. To this end, NotI cleavage sites were introduced at the 5' and 3' ends of the coding sequences, using PCR. The corresponding primer sequences were derived from the 5' and 3' regions of OtElo1, OtElo1.2, OtElo2 and OtElo2.1.
  Composition of the PCR Mix (50 µl):
  5.00 µl template cDNA
  5.00 µl 10× buffer (Advantage polymerase)+25 mM $MgCl_2$
  5.00 µl 2 mM dNTP
  1.25 µl of each primer (10 pmol/µl)
  0.50 µl Advantage polymerase
  The Advantage polymerase from Clontech was employed.
  PCR Reaction Conditions:
  Annealing temperature: 1 min 55° C.
  Denaturation temperature: 1 min 94° C.
  Elongation temperature: 2 min 72° C.
  Number of cycles: 35
  The PCR products are incubated with the restriction enzyme NotI for 16 hours at 37° C. The plant expression vector pSUN300-USP is incubated in the same manner. Thereafter, the PCR products and the vector were separated by agarose gel electrophoresis and the corresponding DNA fragments were excised. The DNA was purified by means of the Qiagen Gel Purification Kit following the manufacturer's instructions. Thereafter, vector and PCR products were ligated. The Rapid Ligation Kit from Roche was used for this purpose. The resulting plasmids pSUN-OtELO1, pSUN-OtELO1.2, pSUN-OtELO2 and pSUN-OtELO2.2 were verified by sequencing.
  pSUN300 is a derivative of plasmid pPZP (Hajdukiewicz, P, Svab, Z, Maliga, P., (1994) The small versatile pPZP family of *Agrobacterium* binary vectors for plant transformation. Plant Mol Biol 25:989-994). pSUN-USP originated from pSUN300, by inserting a USP promoter into pSUN300 in the form of an EcoRI fragment. The polyadenylation signal is that of the *Ostreococcus* gene from the *A. tumefaciens* Ti plasmid (ocs-Terminator, Genbank Accession V00088) (De Greve, H., Dhaese, P., Seurinck, J., Lemmers, M., Van Montagu, M. and Schell, J. Nucleotide sequence and transcript map of the *Agrobacterium tumefaciens* Ti plasmid-encoded octopine synthase gene J. Mol. Appl. Genet. 1 (6), 499-511 (1982)). The USP promoter corresponds to nucleotides 1 to 684 (Genbank Accession X56240), where part of the noncoding region of the USP gene is present in the promoter. The promoter fragment which is 684 base pairs in size was amplified by a PCR reaction and standard methods with the aid of a synthesized primer and by means of a commercially available T7 standard primer (Stratagene).

```
Primer sequence:
                                         SEQ ID NO: 130
5'-GTCGACCCGCGGACTAGTGGGCCCTCTAGACCCGGGGGATCC
GGATCTGCTGGCTATGAA-3'.
```

The PCR fragment was recut with EcoRI/SalI and inserted into the vector pSUN300 with OCS terminator. This gave rise to the plasmid with the name pSUN-USP. The construct was used for the transformation of *Arabidopsis thaliana*, oilseed rape, tobacco and linseed.

Example 46: Expression of OtElo1, OtElo1.2, OtElo2 and OtELO2.2 in Yeasts

Yeasts which had been transformed with the plasmids pYES3, pYES3-OtElO1, pYES3-OtElO1.2, pYES3-OtELO2 and pYES3-OtELO2.2 as described in Example 15 were analyzed as follows:
  The yeast cells from the main cultures were harvested by centrifugation (100×g, 5 min, 20° C.) and washed with 100 mM $NaHCO_3$, pH 8.0 to remove residual medium and fatty acids. Starting with the yeast cell sediments, fatty acid methyl esters (FAMEs) were prepared by acid methanolysis. To this end, the cell sediments were incubated for 1 hour at 80° C. together with 2 ml of 1 N methanolic sulfuric acid and 2% (v/v) of dimethoxypropane. The FAMEs were extracted twice with petroleum ether (PE). To remove nonderivatized fatty acids, the organic phases were washed in each case once with 2 ml of 100 mM $NaHCO_3$, pH 8.0 and 2 ml of distilled water. Thereafter, the PE phases were dried with $Na_2SO_4$, evaporated under argon and taken up in 100 µl of PE. The samples were separated on a DB-23 capillary column (30 m, 0.25 mm, 0.25 µm, Agilent) in a Hewlett-Packard 6850 gas chromatograph equipped with flame ionization detector. The conditions for the GLC analysis were as follows: the oven temperature was programmed from 50° C. to 250° C. with an increment of 5° C./min and finally 10 min at 250° C. (holding).
  The signals were identified by comparing the retention times with corresponding fatty acid standards (Sigma). The methodology is described for example in Napier and Michaelson, 2001, Lipids. 36(8):761-766; Sayanova et al., 2001, Journal of Experimental Botany. 52(360):1581-1585, Sperling et al., 2001, Arch. Biochem. Biophys. 388(2):293-298 and Michaelson et al., 1998, FEBS Letters. 439(3):215-218.

Example 47: Functional Characterization of OtElo1, OtElo1.2, OtElo2 and OtElo2.1

The substrate specificity of OtElo1 was determined after expression and feeding of different fatty acids (Table 18). The substrates which have been fed can be detected in large amounts in all transgenic yeasts. The transgenic yeasts showed the synthesis of novel fatty acids, the products of the OtElo1 reaction. This means that the gene OtElo1 was expressed functionally.
  It can be seen from Table 18 that OtElo1 and OtElo1.2 have a narrow substrate specificity. OtElo1 and OtElo1.2 were only capable of elongating the C20-fatty acids eicosapentaenoic acid (FIG. 24A, 24B) and arachidonic acid (FIG. 25A, 25B), but preference was given to the ω3-desaturated eicosapentaenoic acid.
  Table 18 shows the substrate specificity of the elongase OtElo1 and OtElo1.2 for C20-poly unsaturated fatty acids with a double bond in the Δ5-position in comparison with different fatty acids.
  The yeasts which had been transformed with the vector pOTE1 or pOTE1.2 were cultured in minimal medium in the presence of the fatty acids stated. The fatty acid methyl esters were synthesized by subjecting intact cells to acid methanolysis. Thereafter, the FAMEs were analyzed via GLC.
  The substrate specificity of OtElo2 (SEQ ID NO: 81) OtElo2.1 (SEQ ID NO: 111) can be determined after expression and the feeding of different fatty acids (Table 19). The substrates fed can be detected in large amounts in all of the transgenic yeasts. The transgenic yeasts demonstrated the synthesis of novel fatty acids, the products of the OtElo2 reaction. This means that the genes OtElo2 and OtElo2.1 have been expressed functionally.

TABLE 18

| Fatty acid substrate | Conversion rate of OtElo1 (in %) | Conversion rate of OtElo1.2 (in %) |
|---|---|---|
| 16:0 | — | — |
| 16:1$^{\Delta 9}$ | — | — |
| 18:0 | — | — |
| 18:1$^{\Delta 9}$ | — | — |
| 18:1$^{\Delta 11}$ | — | — |
| 18:2$^{\Delta 9,12}$ | — | — |
| 18:3$^{\Delta 6,9,12}$ | — | — |
| 18:3$^{\Delta 5,9,12}$ | — | — |
| 20:3$^{\Delta 8,11,14}$ | — | — |
| 20:4$^{\Delta 5,8,11,14}$ | 10.8 ± 0.6 | 38.0 |
| 20:5$^{\Delta 5,8,11,14,17}$ | 46.8 ± 3.6 | 68.6 |
| 22:4$^{\Delta 7,10,13,16}$ | — | — |
| 22:6$^{\Delta 4,7,10,13,16,19}$ | — | — |

Table 19 shows the substrate specificity of the elongase OtElo2 and OtElo2.1 with regard to various fatty acids. OtElo2.1 shows a markedly higher activity.

The yeasts which had been transformed with the vector pOTE2 or pOTE2.1 were cultured in minimal medium in the presence of the fatty acids stated. The fatty acid methyl esters were synthesized by subjecting intact cells to acid methanolysis. Thereafter, the FAMEs were analyzed via GLC.

The enzymatic activity shown in Table 19 clearly demonstrates that OtElo2 and OtElo2.1, respectively, are a Δ6-elongase.

TABLE 19

| Fatty acid substrate | Conversion rate of OtElo2 (in %) | Conversion rate of OtElo2.2 (in %) |
|---|---|---|
| 16:0 | — | — |
| 16:1$^{\Delta 9}$ | — | — |
| 16:3$^{\Delta 7,10,13}$ | — | — |
| 18:0 | — | — |
| 18:1$^{\Delta 6}$ | — | — |
| 18:1$^{\Delta 9}$ | — | — |
| 18:1$^{\Delta 11}$ | — | — |
| 18:2$^{\Delta 9,12}$ | — | — |
| 18:3$^{\Delta 6,9,12}$ | 15.3 | 55.7 |
| 18:3$^{\Delta 5,9,12}$ | — | — |
| 18:4$^{\Delta 6,9,12,15}$ | 21.1 | 70.4 |
| 20:2$^{\Delta 11,14}$ | — | — |
| 20:3$^{\Delta 8,11,14}$ | — | — |
| 20:4$^{\Delta 5,8,11,14}$ | — | — |
| 20:5$^{\Delta 5,8,11,14,17}$ | — | — |
| 22:4$^{\Delta 7,10,13,16}$ | — | — |
| 22:5$^{\Delta 7,10,13,16,19}$ | — | — |
| 22:6$^{\Delta 4,7,10,13,16,19}$ | — | — |

FIG. 24 A-D shows the elongation of eicosapentaenoic acid by OtElo1 (B) and OtElo1.2 (D), respectively. The controls (A, C) do not show the elongation product (22:5ω3).

FIG. 25 A-D shows the elongation of arachidonic acid by OtElo1 (B) and OtElo1.2 (D), respectively. The controls (A, C) do not show the elongation product (22:4ω6).

Example 48: Cloning Elongase Genes from *Euglena gracilis* and *Arabidopsis thaliana*

The search for conserved regions in the protein sequences with the aid of the elongase genes with Δ5-elongase activity or Δ6-elongase activity, which are detailed in the application, allowed the identification of sequences from *Arabidopsis thaliana* and *Euglena gracilis*, respectively, with corresponding motifs in sequence databases (Genbank, Euglena EST Bank). The sequences were the following:

| Name of gene | SEQ ID | Amino acids |
|---|---|---|
| EGY1019 (*E. gracilis*) | SEQ ID NO: 131 | 262 |
| EGY2019 (*E. gracilis*) | SEQ ID NO: 133 | 262 |
| At3g06460 (*A. thaliana*) | SEQ ID NO: 135 | 298 |
| At3g06470 (*A. thaliana*) | SEQ ID NO: 137 | 278 |

The *Euglena gracilis* elongases were cloned as follows:
The *Euglena gracilis* strain 1224-5/25 was obtained from the Sammlung für Algenkulturen Göttingen [Göttingen collection of algal cultures] (SAG). For the isolation, the strain was grown for 4 days at 23° C. in medium II (Calvayrac R and Douce R, FEBS Letters 7:259-262, 1970) with a photoperiod of 8 h/16 h (light intensity 35 mol s-1 m-2).

Total RNA of a four-day-old *Euglena* culture was isolated with the aid of the RNAeasy Kit from Qiagen (Valencia, Calif., US). poly-A+ RNA (mRNA) was isolated from the total RNA with the aid of oligo-dT-cellulose (Sambrook et al., 1989). The RNA was subjected to reverse transcription with the Reverse Transcription System Kit from Promega, and the cDNA synthesized was cloned into the lambda ZAP vector (lambda ZAP Gold, Stratagene). The cDNA was depackaged in accordance with the manufacturer's instructions to give the plasmid DNA, and clones were partially sequenced for random sequencing. mRNA was isolated from the total RNA with the aid of the PolyATract isolation system (Promega). The mRNA was subjected to reverse transcription with the Marathon cDNA Amplification Kit (BD Biosciences) and the adaptors were ligated in accordance with the manufacturer's instructions. The cDNA library was then used for the PCR for cloning expression plasmids by means of 5'- and 3'-RACE (rapid amplification of cDNA ends).

The *Arabidopsis thaliana* elongases were cloned as follows:
Starting from the genomic DNA, primers for the two genes were derived at the 5' and the 3' end of the open reading frame.

The method of Chrigwin et al., (1979) was used for isolating total RNA from *A. thaliana*. Leaves from 21-day-old plants were crushed in liquid nitrogen, treated with disruption buffer and incubated for 15 minutes at 37° C. After centrifugation (10 min, 4° C., 12 000×g), the RNA in the supernatant was precipitated at −20° C. for 5 hours using 0.02 volume of 3 M sodium acetate pH 5.0 and 0.75 volume ethanol. After a further centrifugation step, the RNA was taken up in 1 ml of TES per g of starting material, extracted once with one volume of phenol/chloroform and once with one volume of chloroform, and the RNA was precipitated with 2.5 M LiCl. Following subsequent centrifugation and washing with 80% ethanol, the RNA was resuspended in water. The cDNA was synthesized in accordance with the method of Sambrook et al. 1989, and an RT-PCR was carried out using the derived primers. The PCR products were cloned into the vector pYES2.1-TOPO (Invitrogen) in accordance with the manufacturer's instructions.

Example 49: Cloning Expression Plasmids for Heterologous Expression in Yeasts

To characterize the function of the *A. thaliana* elongases, the open reading frames of the DNAs in question were cloned downstream of the galactose-inducible GAL1 promoter of pYES2.1/V5-His-TOPO (Invitrogen), giving rise to pAt60 and pAt70.

The *Saccharomyces cerevisiae* strain 334 was transformed by electroporation (1500 V) with the vector pAt60 and pAt70, respectively. A yeast which was transformed with the blank vector pYES2.1 was used as the control. The transformed yeasts were selected on complete minimal dropout uracil medium (CMdum) agar plates supplemented with 2% glucose. After the selection, in each case three transformants were selected for the further functional expression.

To express the At elongases, precultures of in each case 5 ml of dropout uracil CMdum liquid medium supplemented with 2% (w/v) raffinose were inoculated with the selected transformants and incubated for 2 days at 30° C., 200 rpm.

5 ml of liquid CMdum medium (without uracil) supplemented with 2% raffinose and 300 µM of various fatty acids were then inoculated with the precultures to an $OD_{600}$ of 0.05. The expression was induced by addition of 2% (w/v) galactose. The cultures were incubated for a further 96 hours at 20° C.

Example 50: Expression of pAt60 and pAt70 in Yeasts

Yeasts which had been transformed with the plasmids pYES2.1, pAt60 and pAt70 as described in Example 5 were analyzed as follows:

The yeast cells from the main cultures were harvested by centrifugation (100×g, 5 min, 20° C.) and washed with 100 mM $NaHCO_3$, pH 8.0 to remove residual medium and fatty acids. Starting with the yeast cell sediments, fatty acid methyl esters (FAMEs) were prepared by acid methanolysis. To this end, the cell sediments were incubated for 1 hour at 80° C. together with 2 ml of 1 N methanolic sulfuric acid and 2% (v/v) of dimethoxypropane. The FAMEs were extracted twice with petroleum ether (PE). To remove nonderivatized fatty acids, the organic phases were washed in each case once with 2 ml of 100 mM $NaHCO_3$, pH 8.0 and 2 ml of distilled water. Thereafter, the PE phases were dried with $Na_2SO_4$, evaporated under argon and taken up in 100 µl of PE. The samples were separated on a DB-23 capillary column (30 m, 0.25 mm, 0.25 µm, Agilent) in a Hewlett-Packard 6850 gas chromatograph equipped with flame ionization detector. The conditions for the GLC analysis were as follows: the oven temperature was programmed from 50° C. to 250° C. with an increment of 5° C./min and finally 10 min at 250° C. (holding).

The signals were identified by comparing the retention times with corresponding fatty acid standards (Sigma). The methodology is described for example in Napier and Michaelson, 2001, Lipids. 36(8):761-766; Sayanova et al., 2001, Journal of Experimental Botany. 52(360):1581-1585, Sperling et al., 2001, Arch. Biochem. Biophys. 388(2):293-298 and Michaelson et al., 1998, FEBS Letters. 439(3):215-218.

Example 51: Functional Characterization of pAt60 and pAt70

The substrate specificity of the elongases At3g06460 and At3g06470 was determined after expression and feeding of various fatty acids (Table 20, FIG. 26). The substrates which have been fed can be detected in all transgenic yeasts. The transgenic yeasts showed the synthesis of novel fatty acids, the products of the genes At3g06460 and At3g06470, respectively. This means that these genes have been expressed functionally.

TABLE 20

Elongation of EPA by the elongases At3g06460 and At3g06470, respectively. Measurement of the yeast extracts after feeding of 250 µM EPA

| Gene | Fatty acid fed | C20:5n-3 content | C22:5n-3 content |
|---|---|---|---|
| At3g06460 | EPA (C20:5n-3) | 20.8 | 0.6 |
| At3g06460 | EPA (C20:5n-3) | 25.4 | 1.1 |

Conversion rate of EPA At3g06460: 3.0% At3g06470: 4.1%

FIG. 26 represents the elongation of 20:5n-3 by the elongases At3g06470.

Example 52: Cloning an Elongase from *Phaeodactylum tricornutum*

Starting from conserved regions in the protein sequences, degenerate primers were constructed with the aid of the elongase genes with Δ6-elongase activity detailed in the application, and these primers were used for searching a *Phaeodactylum* cDNA library by means of PCR. The following primer sequences were employed:

| Name of primer | Sequence 5'-3' orientation | Corresponding amino acids |
|---|---|---|
| Phaelo forward1 | AA(C/T)CTUCTUTGG CTUTT(C/T)TA (SEQ ID NO: 185) | NLLWLFY (SEQ ID NO: 254) |
| Phaelo reverse1 | GA(C/T)TGUAC(A/G) AA(A/G)AA(C/T)TGU GC(A/G)AA (SEQ ID NO: 186) | FAQFFVQS (SEQ ID NO: 255) |

Nucleotide bases in brackets mean that a mixture of oligonucleotides with in each case one or the other nucleotide base are present.

Construction of the *Phaeodactylum* cDNA library:

A 2 l culture of *P. tricornutum* UTEX 646 was grown in f/2 medium (Guillard, R. R. L. 1975. Culture of phytoplankton for feeding marine invertebrates. In *Culture of Marine Invertebrate Animals* (Eds. Smith, W. L. and Chanley, M. H.), Plenum Press, New York, pp 29-60) for 14 d (=days) at a light intensity of 35 $E/cm^2$. After centrifugation, frozen cells were ground to a fine powder in the presence of liquid nitrogen and resuspended in 2 ml of homogenization buffer (0.33 M sorbitol, 0.3 M NaCl, 10 mM EDTA, 10 mM EGTA, 2% SDS, 2% mercaptoethanol in 0.2 M Tris-CI pH 8.5). After 4 ml of phenol and 2 ml of chloroform had been added, the mixture was shaken vigorously for 15 minutes at 40-50° C. Thereafter, the mixture was centrifuged (10 min×10 000 g) and the aqueous phase was extracted stepwise with chloroform. Nucleic acids were then precipitated by addition of 1/20 volume 4 M sodium hydrogencarbonate solution and centrifuged. The pellet was taken up in 80 mM Tris-borate pH 7.0 and 1 mM EDTA, and the RNA was precipitated with 8 M lithium chloride. After centrifugation and washing with 70% strength ethanol, the RNA pellet was taken up in RNase-free water. Poly(A)-RNA was isolated using Dynabeads (Dynal, Oslo, Norway) following the manufacturer's instructions, and the first-strand cDNA synthesis was carried out using MLV-Rtase from Roche (Mannheim). Then, the second-strand synthesis was carried out using DNA polymerase I and Klenow fragment, followed by a digestion with RNaseH. The cDNA was then treated with T4 DNA polymerase, and EcoRI/XhoI adaptors (Pharmacia, Freiburg) were subsequently attached by means of T4 ligase. After digestion with XhoI, phosphorylation and gel separation, fragments greater than 300 bp were ligated into the phage lambda ZAP Express following the manufacturer's instructions (Stratagene, Amsterdam, the Netherlands). Following bulk excision of the cDNA library and plasmid recovery, the plasmid library was transformed into E. coli DH10B cells and employed for the PCR screening.

Using the abovementioned degenerate primers, it was possible to generate the PCR fragment with the sequence number SEQ ID NO: 187.

This fragment was labeled with digoxigenin (Roche, Mannheim) and used as probe for screening the phage library.

With the aid of the sequence SEQ ID NO: 187, it was possible to obtain the gene sequence SEQ ID NO: 183, which constitutes the full-RNA molecule of the *Phaeodactylum* Δ6-elongase:

Example 53: Cloning Expression Plasmids for the Heterologous Expression in Yeasts The relevant primer pairs were selected in such a way that they bore the yeast consensus sequence for highly efficient translation (Kozak, Cell 1986, 44:283-292) next to the start codon. The amplification of the PtELO6 DNAs was carried out in each case using 1 µl of cDNA, 200 µM of dNTPs, 2.5 U Advantage polymerase and 100 pmol of each primer in a total volume of 50 µl. The PCR conditions were as follows: first denaturation for 5 minutes at 95° C., followed by 30 cycles of 30 seconds at 94° C., 1 minute at 55° C. and 2 minutes at 72° C., and a last elongation step of 10 minutes at 72° C.

To clone the sequence for the heterologous expression in yeasts, the following oligonucleotides were used for the PCR reaction:

| Name of gene and SEQ ID NO: | Primer sequence |
|---|---|
| PtELO6 (SEQ ID NO: 183) | F:5'-GCGGCCGCACATA ATGATGGTACCTTCAAG (SEQ ID NO: 188) R:3'-GAAGACAGCTTAA TAGACTAGT (SEQ ID NO: 189) |

*F = forward primer, R = reverse primer

The PCR products were incubated for 30 minutes at 21° C. with the yeast expression vector pYES2.1-TOPO (Invitrogen) following the manufacturer's instructions. The PCR product (see SEQ ID NO: 192) was ligated into the vector by means of a T overhang and activity of a topoisomerase (Invitrogen). After incubation, E. coli DH5α cells were transformed. Suitable clones were identified by PCR, the plasmid DNA was isolated by means of Qiagen DNAeasy Kit and verified by sequencing. The correct sequence was then transformed into the *Saccharomyces* strain INVSc1 (Invitrogen) by electroporation (1500 V). As a control, the blank vector pYES2.1 was transformed in parallel. The yeasts were subsequently plated onto complete uracil dropout minimal medium supplemented with 2% glucose. Cells which were capable of growing in the medium without uracil thus comprise the corresponding plasmids pYES2.1 and pYES2.1-PtELO6. After the selection, in each case two transformants were selected for further functional expression.

Example 54: Cloning Expression Plasmids for the Seed-Specific Expression in Plants A further transformation vector based on pSUN-USP is generated for the transformation of plants. To this end, NotI cleavage sites are introduced at the 5' and 3' ends of the coding sequence, using the following primer pair:

PSUN-PtELO6

```
Forward:
                                        (SEQ ID NO: 190)
5'-GCGGCCGCACCATGATGGTACCTTCAAGTTA Reverse:
                                        (SEQ ID NO: 191)
3'-GAAGACAGCTTAATAGGCGGCCGC
```

Composition of the PCR Mix (50 µl):
5.00 µl template cDNA
5.00 µl 10× buffer (Advantage polymerase)+25 mM MgCl$_2$
5.00 µl 2 mM dNTP
1.25 µl of each primer (10 pmol/µl)
0.50 µl Advantage polymerase
The Advantage polymerase from Clontech was employed.
PCR Reaction Conditions:
Annealing temperature: 1 min 55° C.
Denaturation temperature: 1 min 94° C.
Elongation temperature: 2 min 72° C.
Number of cycles: 35

The PCR products are incubated with the restriction enzyme NotI for 16 hours at 37° C. The plant expression vector pSUN300-USP is incubated in the same manner. Thereafter, the PCR products and the 7624 bp vector are separated by agarose gel electrophoresis and the corresponding DNA fragments are excised. The DNA is purified by means of the Qiagen Gel Purification Kit following the manufacturer's instructions. Thereafter, vector and PCR products are ligated. The Rapid Ligation Kit from Roche is used for this purpose. The resulting plasmids pSUN-PtELO is verified by sequencing.

pSUN300 is a derivative of plasmid pPZP (Hajdukiewicz, P, Svab, Z, Maliga, P., (1994) The small versatile pPZP family of *Agrobacterium* binary vectors for plant transformation. Plant Mol Biol 25:989-994). pSUN-USP originated from pSUN300, by inserting a USP promoter into pSUN300 in the form of an EcoRI fragment. The polyadenylation signal is that of the Octopine synthase gene from the *A. tumefaciens* Ti plasmid (ocs-Terminator, Genbank Accession V00088) (De Greve, H., Dhaese, P., Seurinck, J., Lemmers, M., Van Montagu, M. and Schell, J. Nucleotide sequence and transcript map of the *Agrobacterium tumefaciens* Ti plasmid-encoded octopine synthase gene J. Mol. Appl. Genet. 1 (6), 499-511 (1982)). The USP promoter corresponds to nucleotides 1 to 684 (Genbank Accession X56240), where part of the noncoding region of the USP gene is present in the promoter. The promoter fragment which is 684 base pairs in size was amplified by a PCR reaction and standard methods with the aid of a synthesized primer and by means of a commercially available T7 standard primer (Stratagene).

(Primer sequence:
5'-GTCGACCCGCGGACTAGTGGGCCCTCTAGACCCGGGGGATCC
GGATCTGCTGGCTATGAA-3'; SEQ ID NO: 151).

The PCR fragment was recut with EcoRI/SalI and inserted into the vector pSUN300 with OCS terminator. This gave rise to the plasmid with the name pSUN-USP. The construct was used for the transformation of *Arabidopsis thaliana*, oilseed rape, tobacco and linseed.

Lipids were extracted from yeasts and seeds as described for Example 6.

Example 55: Expression of PtElo in Yeasts

Yeasts which had been transformed with the plasmids pYES2 and pYES2-PtELO6 as in Example 4 were analyzed as follows:

The yeast cells from the main cultures were harvested by centrifugation (100×g, 5 min, 20° C.) and washed with 100 mM NaHCO$_3$, pH 8.0 in order to remove residual medium and fatty acids. Fatty acid methyl esters (FAMEs) were prepared from the yeast cell sediments by acid methanolysis. To this end, the cell sediments were incubated for 1 hour at 80° C. with 2 ml of 1N methanolic sulfuric acid and 2% (v/v) dimethoxypropane. The FAMEs were extracted by twice extracting with petroleum ether (PE). To remove nonderivatized fatty acids, the organic phases were washed in each case once with 2 ml of 100 mM NaHCO$_3$, pH 8.0, and 2 ml of distilled water. Thereafter, the PE phases were dried with Na$_2$SO$_4$, evaporated under argon and taken up in 100 µl of PE. The samples were separated on a DB-23 capillary column (30 m, 0.25 mm, 0.25 µm, Agilent) in a Hewlett-Packard 6850 gas chromatograph with flame ionization detector. The conditions for the GLC analysis were as follows: the oven temperature was programmed from 50° C. to 250° C. with an increment of 5° C./min and finally 10 minutes at 250° C. (holding).

The signals were identified by comparing the retention times with corresponding fatty acid standards (Sigma). The methodology is described for example in Napier and Michaelson, 2001, Lipids. 36(8):761-766; Sayanova et al., 2001, Journal of Experimental Botany. 52(360):1581-1585, Sperling et al., 2001, Arch. Biochem. Biophys. 388(2):293-298 and Michaelson et al., 1998, FEBS Letters. 439(3):215-218.

Example 56: Functional Characterization of PtELO6

FIG. 29 represents the conversion of C18:3$^{\Delta 6,9,12}$ and C18.4$^{\Delta 6,9,12,15}$. The substrates are elongated by in each case two carbon atoms; this results in the fatty acids C20:3$^{\Delta 8,11,14}$ and C20:4$^{\Delta 8,11,14,17}$, respectively. The substrate specificity of PtELO6 can be determined after expression and the feeding of different fatty acids (FIG. 30). The substrates fed can be detected in large amounts in all of the transgenic yeasts. The transgenic yeasts demonstrated the synthesis of novel fatty acids, the products of the PtElo6 reaction. This means that the gene PtElO6 has been expressed functionally.

It can be seen from Table 21 that PtElo6 shows a narrow substrate specificity. PtELO6 was only capable of elongating the C18-fatty acids linoleic acid, linolenic acid, γ-linolenic acid and stearidonic acid, but preferred the ω3-desaturated stearidonic acid (see also FIG. 30).

Feeding experiment: fatty acids (in bold) were added in each case in amounts of 250 µM. The underlined fatty acids were formed de novo.

TABLE 21

Substrate specificity of PtElo6

| | Fatty acid fed: | | | |
|---|---|---|---|---|
| | +18:2 | +18:3 | +18:3 | +18:4 |
| 16:0 | 16.2 | 18.2 | 15.2 | 20 | 04:48 |
| 16:1 | 50.6 | 20.5 | 22.8 | 33.5 | 34.2 |
| 18:0 | 5.4 | 6.3 | 6.2 | 5.2 | 12.4 |
| 18:1 | 27.7 | 14.6 | 19.6 | 19.3 | 16.7 |
| 18:2 | | 40 | | | |
| 18:3 | | | 32.9 | | |
| 18:3 | | | | 12.3 | |
| 18:4 | | | | | 4.5 |
| 20:2 | | 0.4 | | | |
| 20:3 | | | 3.4 | | |
| 20:3 | | | | 9.7 | |
| 20:4 | | | | | 14.5 |
| % elongation | 0.0 | 0.99 | 9.37 | 44.09 | 76.32 |

The following fatty acids were fed, but not converted:
18:1$^{\Delta 6}$, 18:1$^{\Delta 9}$, 18:1$^{\Delta 11}$
20:2$^{\Delta 11,14}$, 20:3$^{\Delta 11,14,17}$, 20:3$^{\Delta 8,11,14}$, 20:4$^{\Delta 5,8,11,14}$, 20:5$^{\Delta 5,8,11,14,17}$
22:4$^{\Delta 7,10,13,16}$ The yeasts which had been transformed with the vector pYES2-PtELO6 were cultured in minimal medium in the presence of the fatty acids detailed. The fatty acid methyl esters were synthesized by subjecting intact cells to acid methanolysis. Thereafter, the FAMEs were analyzed via GLC. The results shown in FIGS. 29 and 30 and in Table 19 were thus determined.

Example 57: Cloning Expression Plasmids for the Seed-Specific Expression in Plants The general conditions described hereinbelow apply to all of the subsequent experiments, unless otherwise specified.

The following are preferably used in accordance with the invention for the examples which follow: Bin19, pBI101, pBinAR, pGPTV and pCAMBIA. An overview of binary vectors and their use is found in Hellens et al., Trends in Plant Science (2000) 5, 446-451. A pGPTV derivative as described in DE10205607 was used. This vector differs from pGPTV by an additionally inserted AscI restriction cleavage site.

Starting point of the cloning procedure was the cloning vector pUC19 (Maniatis et al.). In the first step, the Conlinin promoter fragment was amplified using the following primers:

Cnl1 C 5':
(SEQ ID NO: 203)
gaattcggcgcgccgagctcctcgagcaacggttccggcggtata
gagttgggtaattcga Cnl1 C 3':
(SEQ ID NO: 204)
cccgggatcgatgccggcagatctccaccatttttggtggtgat Composition of the PCR Mix (50 µl):
5.00 µl template cDNA
5.00 µl 10× buffer (Advantage polymerase)+25 mM MgCl$_2$
5.00 µl 2 mM dNTP
1.25 µl of each primer (10 pmol/µl)
0.50 µl Advantage polymerase (Clontech)
PCR Reaction Conditions:
Annealing temperature: 1 min 55° C.

Denaturation temperature: 1 min 94° C.
Elongation temperature: 2 min 72° C.
Number of cycles: 35

The PCR product was first incubated with the restriction enzyme EcoRI for 2 hours at 37° C. and then for 12 hours at 25° C. with the restriction enzyme SmaI. The cloning vector pUC19 was incubated in the same manner. Thereafter, the PCR product and the cut, 2668 bp vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1-C was verified by sequencing.

In the next step, the OCS terminator (Genbank Accession V00088; De Greve, H., Dhaese, P., Seurinck, J., Lemmers, M., Van Montagu, M. and Schell, J. Nucleotide sequence and transcript map of the *Agrobacterium tumefaciens* Ti plasmid-encoded octopine synthase gene J. Mol. Appl. Genet. 1 (6), 499-511 (1982)) from the vector pGPVT-USP/OCS (DE 102 05 607) was amplified using the following primers:

```
OCS_C 5':
                                        (SEQ ID NO: 205)
aggcctccatggcctgctttaatgagatatgcgagacgcc OCS_C 3':
                                        (SEQ ID NO: 206)
cccgggccggacaatcagtaaattgaacggag
```

Composition of the PCR Mix (50 μl):
5.00 μl template cDNA
5.00 μl 10× buffer (Advantage polymerase)+25 mM MgCl$_2$
5.00 μl 2 mM dNTP
1.25 μl of each primer (10 pmol/μl)
0.50 μl Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated with the restriction enzyme StuI for 2 hours at 37° C. and then for 12 hours at 25° C. with the restriction enzyme SmaI. The vector pUC19-Cnl1-C was incubated for 12 hours at 25° C. with the restriction enzyme SmaI. Thereafter, the PCR product and the cut vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1-C_OCS was verified by sequencing.

In the next step, the Cnl1-B promoter was amplified by PCR using the following primers:

```
Cnl1-B 5':
                                        (SEQ ID NO: 207)
aggcctcaacggttccggcggtatag Cnl1-B 3':
                                        (SEQ ID NO: 208)
cccggggttaacgctagcgggcccgatatcggatcccattttttg
gtggtgattggttct
```

Composition of the PCR Mix (50 μl):
5.00 μl template cDNA
5.00 μl 10× buffer (Advantage polymerase)+25 mM MgCl$_2$
5.00 μl 2 mM dNTP
1.25 μl of each primer (10 pmol/μl)
0.50 μl Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated with the restriction enzyme StuI for 2 hours at 37° C. and then for 12 hours at 25° C. with the restriction enzyme SmaI. The vector pUC19-Cnl1-C was incubated for 12 hours at 25° C. with the restriction enzyme SmaI. Thereafter, the PCR product and the cut vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1C_Cnl1B_OCS was verified by sequencing.

In a further step, the OCS terminator for Cnl1B was inserted. To this end, the PCR was carried out with the following primers:

```
OCS2 5':
                                        (SEQ ID NO: 209)
aggcctcctgctttaatgagatatgcgagac OCS2 3':
                                        (SEQ ID NO: 210)
cccgggcggacaatcagtaaattgaacggag
```

Composition of the PCR Mix (50 μl):
5.00 μl template cDNA
5.00 μl 10× buffer (Advantage polymerase)+25 mM MgCl$_2$
5.00 μl 2 mM dNTP
1.25 μl of each primer (10 pmol/μl)
0.50 μl Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated with the restriction enzyme StuI for 2 hours at 37° C. and then for 12 hours at 25° C. with the restriction enzyme SmaI. The vector pUC19-Cnl1C_Cnl1B_OCS was incubated for 12 hours at 25° C. with the restriction enzyme SmaI. Thereafter, the PCR product and the cut vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1C_Cnl1B_OCS2 was verified by sequencing.

In the next step, the Cnl1-A promoter was amplified by PCR using the following primers:

```
Cnl1-B 5':
                                        (SEQ ID NO: 211)
aggcctcaacggttccggcggtatagag
```

-continued

Cnl1-B 3':
(SEQ ID NO: 212)
aggccttctagactgcaggcggccgcccgcatttttggtggtgattggt

Composition of the PCR Mix (50 µl):
5.00 µl template cDNA
5.00 µl 10× buffer (Advantage polymerase)+25 mM MgCl$_2$
5.00 µl 2 mM dNTP
1.25 µl of each primer (10 pmol/µl)
0.50 µl Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was incubated for 2 hours at 37° C. with the restriction enzyme StuI. The vector pUC19-Cnl1-C was incubated for 12 hours at 25° C. with the restriction enzyme SmaI. Thereafter, the PCR product and the cut vector were separated by agarose gel electrophoresis and the corresponding DNA fragments were excised. The DNA was purified by means of the Qiagen Gel Purification Kit in accordance with the manufacturer's instructions. Thereafter, vector and PCR product were ligated. The Rapid Ligation Kit from Roche was used for this purpose. The resulting plasmid pUC19-Cnl1C_Cnl1B_Cnl1A_OCS2 was verified by sequencing.

In a further step, the OCS terminator for Cnl1A was inserted. To this end, the PCR was carried out with the following primers:

OCS2 5':
(SEQ ID NO: 213)
ggcctcctgctttaatgagatatgcga

OCS2 3':
(SEQ ID NO: 214)
aagcttggcgcgccgagctcgtcgacggacaatcagtaaattgaacggaga

Composition of the PCR Mix (50 µl):
5.00 µl template cDNA
5.00 µl 10× buffer (Advantage polymerase)+25 mM MgCl$_2$
5.00 µl 2 mM dNTP
1.25 µl of each primer (10 pmol/µl)
0.50 µl Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated with the restriction enzyme StuI for 2 hours at 37° C. and then for 2 hours at 37° C. with the restriction enzyme HindIII. The vector pUC19-Cnl1C_Cnl1B_Cnl1A_OCS2 was incubated for 2 hours at 37° C. with the restriction enzyme StuI and for 2 hours at 37° C. with the restriction enzyme HindIII. Thereafter, the PCR product and the cut vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1C_Cnl1B_Cnl1A_OCS3 was verified by sequencing.

In the next step, the plasmid pUC19-Cnl1C_Cnl1B_Cnl1A_OCS3 was used for cloning the Δ6-, Δ5-desaturase and Δ6-elongase. To this end, the Δ6-desaturase from *Phytium irregulare* (WO02/26946) was amplified using the following PCR primers:

D6Des(Pir) 5':
(SEQ ID NO: 215)
agatctatggtggacctcaagcctggagtg

D6Des(Pir) 3':
(SEQ ID NO: 216)
ccatggcccgggttacatcgctgggaactcggtgat

Composition of the PCR Mix (50 µl):
5.00 µl template cDNA
5.00 µl 10× buffer (Advantage polymerase)+25 mM MgCl$_2$
5.00 µl 2 mM dNTP
1.25 µl of each primer (10 pmol/µl)
0.50 µl Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated with the restriction enzyme BglII for 2 hours at 37° C. and then for 2 hours at 37° C. with the restriction enzyme NcoI. The vector pUC19-Cnl1C_Cnl1B_Cnl1A_OCS3 was incubated for 2 hours at 37° C. with the restriction enzyme BglII and for 2 hours at 37° C. with the restriction enzyme NcoI. Thereafter, the PCR product and the cut vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1_d6Des(Pir) was verified by sequencing.

In the next step, the plasmid pUC19-Cnl1_d6Des(Pir) was used for cloning the Δ5-desaturase from *Thraustochytrium* ssp. (WO02/26946). To this end, the Δ5-desaturase from *Thraustochytrium* ssp. was amplified using the following PCR primers:

D5Des(Tc) 5':
(SEQ ID NO: 217)
gggatccatgggcaagggcagcgagggccg

D5Des(Tc) 3':
(SEQ ID NO: 218)
ggcgccgacaccaagaagcaggactgagatatc

Composition of the PCR Mix (50 µl):
5.00 µl template cDNA
5.00 µl 10× buffer (Advantage polymerase)+25 mM MgCl$_2$
5.00 µl 2 mM dNTP
1.25 µl of each primer (10 pmol/µl)
0.50 µl Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated with the restriction enzyme BamHI for 2 hours at 37° C. and then for 2 hours at 37° C. with the restriction enzyme EcoRV. The vector pUC19-Cnl1_d6Des(Pir) was incubated for 2 hours at 37°

C. with the restriction enzyme BamHI and for 2 hours at 37° C. with the restriction enzyme EcoRV. Thereafter, the PCR product and the cut vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1_d6Des(Pir)_d5Des(Tc) was verified by sequencing.

In the next step, the plasmid pUC19-Cnl1_d6Des(Pir)_d5Des(Tc) was used for cloning the Δ6-elongase from *Physcomitrella patens* (WO01/59128), to which end an amplification with the following PCR primers was carried out:

```
D6Elo(Pp) 5':
                                      (SEQ ID NO: 219)
gcggccgcatggaggtcgtggagagattctacggtg D6Elo(Pp) 3':
                                      (SEQ ID NO: 220)
gcaaaagggagctaaaactgagtgatctaga
```

Composition of the PCR Mix (50 μl):
5.00 μl template cDNA
5.00 μl 10× buffer (Advantage polymerase)+25 mM MgCl$_2$
5.00 μl 2 mM dNTP
1.25 μl of each primer (10 pmol/μl)
0.50 μl Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated with the restriction enzyme NotI for 2 hours at 37° C. and then for 2 hours at 37° C. with the restriction enzyme XbaI. The vector pUC19-Cnl1_d6Des(Pir)_d5Des(Tc) was incubated for 2 hours at 37° C. with the restriction enzyme NotI and for 2 hours at 37° C. with the restriction enzyme XbaI. Thereafter, the PCR product and the cut vector were separated by agarose gel electrophoresis and the corresponding DNA fragments were excised. The DNA was purified by means of the Qiagen Gel Purification Kit following the manufacturer's instructions. Thereafter, vector and PCR product were ligated. The Rapid Ligation Kit from Roche was used for this purpose. The resulting plasmid pUC19-Cnl1_d6Des(Pir)_d5Des(Tc)_D6Elo(Pp) was verified by sequencing.

The binary vector for the plant transformation was generated starting from pUC19-Cnl1_d6Des(Pir)_d5Des(Tc)_D6Elo(Pp). To this end, pUC19-Cnl1_d6Des(Pir)_d5Des(Tc)_D6Elo(Pp) was incubated for 2 hours at 37° C. with the restriction enzyme AscI. The vector pGPTV was treated in the same manner. Thereafter, the fragment from pUC19-Cnl1_d6Des(Pir)_d5Des(Tc)_D6Elo(Pp) and the cut pGPTV vector were separated by agarose gel electrophoresis and the relevant DNA fragments were excised. The DNA was purified by means of the Qiagen Gel Purification Kit in accordance with the manufacturer's instructions. Thereafter, vector and PCR product were ligated. The Rapid Ligation Kit from Roche was used for this purpose. The resulting plasmid pGPTV-Cnl1_d6Des(Pir)_d5Des(Tc)_D6Elo(Pp) was verified by sequencing.

A further construct, pGPTV-Cnl1_d6Des(Pir)_d5Des(Tc)_D6Elo(Pp)_D12Des(Co), was used. To this end, an amplification was performed starting from pUC19-Cnl1C_OCS, using the following primers:

```
Cnl1_OCS 5':
                                      (SEQ ID NO: 221)
gtcgatcaacggttccggcggtatagagttg Cnl1_OCS 3':
                                      (SEQ ID NO: 222)
gtcgatcggacaatcagtaaattgaacggaga
```

Composition of the PCR Mix (50 μl):
5.00 μl template cDNA
5.00 μl 10× buffer (Advantage polymerase)+25 mM MgCl$_2$
5.00 μl 2 mM dNTP
1.25 μl of each primer (10 pmol/μl)
0.50 μl Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was incubated for 2 hours at 37° C. with the restriction enzyme SalI. The vector pUC19 was incubated for 2 hours at 37° C. with the restriction enzyme SalI. Thereafter, the PCR product and the cut vector were separated by agarose gel electrophoresis and the corresponding DNA fragments were excised. The DNA was purified by means of the Qiagen Gel Purification Kit in accordance with the manufacturer's instructions. Thereafter, vector and PCR product were ligated. The Rapid Ligation Kit from Roche was used for this purpose. The resulting plasmid pUC19-Cnl1_OCS was verified by sequencing.

In a further step, the Δ12-desaturase gene from *Calendula officinalis* (WO01/85968) was cloned into pUC19-Cnl1_OCS. To this end, d12Des(Co) was amplified using the following primers:

```
D12Des(Co) 5':
                                      (SEQ ID NO: 223)
agatctatgggtgcaggcggtcgaatgc D12Des(Co) 3':
                                      (SEQ ID NO: 224)
ccatggttaaatcttattacgatacc
```

Composition of the PCR Mix (50 μl):
5.00 μl template cDNA
5.00 μl 10× buffer (Advantage polymerase)+25 mM MgCl$_2$
5.00 μl 2 mM dNTP
1.25 μl of each primer (10 pmol/μl)
0.50 μl Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was incubated for 2 hours at 37° C. with the restriction enzyme BglII and subsequently for 2 hours at the same temperature with NcoI. The vector pUC19-Cnl1_OCS was incubated in the same manner. Thereafter, the PCR product and the cut vector were separated by agarose gel electrophoresis and the corresponding DNA fragments were excised. The DNA was purified by means of the Qiagen Gel Purification Kit in accordance with the manufacturer's instructions. Thereafter, vector and PCR product were ligated. The Rapid Ligation Kit from Roche was used for this purpose. The resulting plasmid pUC19-Cnl1_D12Des(Co) was verified by sequencing.

The plasmid pUC19-Cnl1_D12Des(Co) and the plasmid pUC19-Cnl1_d6Des(Pir)_d5Des(Tc)_D6Elo(Pp) were incubated for 2 hours at 37° C. with the restriction enzyme SalI. Thereafter, the vector fragment and the vector were separated by agarose gel electrophoresis and the relevant DNA fragments were excised. The DNA was purified by means of the Qiagen Gel Purification Kit in accordance with the manufacturer's instructions. Thereafter, vector and vector fragment were ligated. The Rapid Ligation Kit from Roche was used for this purpose. The resulting plasmid pUC19-Cnl1_d6Des(Pir)_d5Des(Tc)_D6Elo(Pp)_D12Des(Co) was verified by sequencing.

The binary vector for the plant transformation was generated starting from pUC19-Cnl1_d6Des(Pir)_d5Des (Tc)_D6Elo(Pp)_D12Des(Co). To this end, pUC19-Cnl1_d6Des(Pir)_d5Des(Tc)_D6Elo(Pp)_D12Des(Co) was incubated for 2 hours at 37° C. with the restriction enzyme AscI. The vector pGPTV was treated in the same manner. Thereafter, the fragment from pUC19-Cnl1_d6Des(Pir)_d5Des(Tc)_D6Elo(Pp)_D12Des(Co) and the cut pGPTV vector were separated by agarose gel electrophoresis and the relevant DNA fragments were excised. The DNA was purified by means of the Qiagen Gel Purification Kit in accordance with the manufacturer's instructions. Thereafter, vector and PCR product were ligated. The Rapid Ligation Kit from Roche was used for this purpose. The resulting plasmid pGPTV-Cnl1_d6Des(Pir)_d5Des(Tc)_D6Elo(Pp)_D12Des (Co) was verified by sequencing.

A further vector which is suitable for the transformation of plants is pSUN2. To increase the number of expression cassettes present in the vector to more than four, this vector was used in combination with the Gateway System (Invitrogen, Karlsruhe). To this end, the Gateway cassette A was inserted into the vector pSUN2 in accordance with the manufacturer's instructions as described hereinbelow:

The pSUN2 vector (1 μg) was incubated for 1 hour with the restriction enzyme EcoRV at 37° C. Thereafter, the Gateway cassette A (Invitrogen, Karlsruhe) was ligated into the cut vector by means of the Rapid Ligation Kit from Roche, Mannheim. The resulting plasmid was transformed into E. coli DB3.1 cells (Invitrogen). The isolated plasmid pSUN-GW was subsequently verified by sequencing.

In the second step, the expression cassette was excised from pUC19-Cnl1_d6Des(Pir)_d5Des(Tc)_D6Elo(Pp)_D12Des(Co) by means of AscI and ligated into the vector pSUN-GW, which had been treated in the same manner. The resulting plasmid pSUN-4G was used for further gene constructs.

To this end, a pENTR clone was first modified in accordance with the manufacturer's instructions (Invitrogen). The plasmid pENTR1A (Invitrogen) was incubated for 1 hour at 37° C. with the restriction enzyme EcorI, subsequently treated for 30 minutes with Klenow enzyme and with one 1 μM dNTP mix, and the AscI adaptor (5'-ggcgcgcc; phosphorylated at the 5' terminus, double-stranded) was then ligated into the vector pENTR1A. Into this modified, genes were stepwise inserted into the Cnl cassette as described above and transferred into the pENTR vector via AscI.

The gene TL16y2 from *Thraustochytrium* ssp. (SEQ ID NO: 83) was transferred into the pSUN-4G vector in the abovedescribed manner:

In the next step, the plasmid pUC19-Cnl1C_Cnl1B_Cnl1A_OCS3 was used for cloning the Δ5-elongase TL16y2. To this end, the Δ5-elongase from *Thraustochytrium* ssp. was amplified using the following PCR primers:

```
TL16y2 5':
                                  (SEQ ID NO: 225)
    agatct atggacgtcgtcgagcagca TL16y2 3':
                                  (SEQ ID NO: 226)
    ccatggcccggg agaagcagaagaccatctaa
```

Composition of the PCR Mix (50 μl):
5.00 μl template cDNA
5.00 μl 10× buffer (Advantage polymerase)+25 mM $MgCl_2$
5.00 μl 2 mM dNTP
1.25 μl of each primer (10 pmol/μl)
0.50 μl Advantage polymerase (Clontech)
PCR Reaction Conditions:
Annealing temperature: 1 min 55° C.
Denaturation temperature: 1 min 94° C.
Elongation temperature: 2 min 72° C.
Number of cycles: 35

The PCR product was first incubated for 2 hours at 37° C. with the restriction enzyme BglII and then for 2 hours at 37° C. with the restriction enzyme NcoI. The vector pUC19-Cnl1C_Cnl1B_Cnl1A_OCS3 was incubated for 2 hours at 37° C. with the restriction enzyme BglII and for 2 hours at 37° C. with the restriction enzyme NcoI. Thereafter, the PCR product and the cut vector were separated by agarose gel electrophoresis and the relevant DNA fragments were excised. The DNA was purified by means of the Qiagen Gel Purification Kit in accordance with the manufacturer's instructions. Thereafter, vector and PCR product were ligated. The Rapid Ligation Kit from Roche was used for this purpose. The resulting plasmid pUC19-Cnl1_TL16y2 was verified by sequencing. Thereafter, the cassette was excised using AscI and ligated into an AscI-pretreated pENTR vector. The resulting plasmid pENTR-Cnl1_TL16y2 was then incubated with the vector pSUN-4G in a recombination reaction in accordance with the manufacturer's instructions (Invitrogen). The product gave the vector pSUN-5G, which was used for the transformation of plants.

In a further step, the construct pSUN-8G was generated using the above-described methodology. To this end, 5' and 3' primers for the genes SEQ ID 41, 53, 87 and 113 with the above-described restriction cleavage sites and the first and in each case last 20 nucleotides of the open reading frame were generated, amplified under the standard conditions (see above) and ligated into the vector pENTR-Cnl.

A recombination reaction with the vector pSUN-4G gave rise to the construct pSUN-8G. This vector too was employed for the transformation of plants.

Example 58: Generation of Transgenic Plants a) Generation of Transgenic Indian Mustard Plants. The Protocol for the Transformation of Oilseed Rape Plants was Used (Modification of the Method of Moloney et al., 1992, Plant Cell Reports, 8:238-242)

To generate transgenic plants, the binary vectors pGPTV-Cnl1_d6Des(Pir)_d5Des(Tc)_D6Elo(Pp)_D12Des(Co), pSUN-5G and pSUN-8G which had been generated were transformed into *Agrobacterium tumefaciens* C58C1: pGV2260 (Deblaere et al., 1984, Nucl. Acids Res. 13, 4777-4788). To transform Indian mustard plants, a 1:50 dilution of an overnight culture of a positively transformed agrobacterial colony in Murashige-Skoog medium (Murashige and Skoog 1962 Physiol. Plant. 15, 473) supplemented with 3% sucrose (3MS medium) was used. Petioles or hypocotyls of freshly germinated sterile plants (in each case approx. 1 cm$^2$) were incubated for 5-10 minutes with a 1:50 agrobacterial dilution in a Petri dish. This is followed by 3 days of coincubation in the dark at 25° C. on 3MS medium supplemented with 0.8% Bacto agar. Cultivation was subsequently continued at 16 hours light/8 hours dark and in a weekly rhythm on MS medium supplemented with 500 mg/l of Claforan (cefotaxime-sodium), 50 mg/l kanamycin, 20 µM benzylaminopurine (BAP) and 1.6 g/l glucose. Growing shoots were transferred to MS medium supplemented with 2% sucrose, 250 mg/l Claforan and 0.8% Bacto agar. If no roots had formed after three weeks, 2-indolebutyric acid was added to the medium for rooting, to act as growth hormone.

Regenerated shoots were maintained on 2MS medium supplemented with kanamycin and Claforan, after rooting, transferred into soil and, after cultivation, grown for two weeks in a controlled-environment cabinet or in a greenhouse, allowed to flower, mature seeds were harvested and studied for elongase expression such as Δ6-elongase activity or Δ5- or Δ6-desaturase activity by means of lipid analyses. In this manner, lines with elevated contents of C20- and C22-polyunsaturated fatty acids were identified.

Transgenic oilseed rape plants were also generated successfully using this protocol.

b) Generation of Transgenic Linseed Plants

The transgenic linseed plants can be generated for example by the method of Bell et al., 1999, In Vitro Cell. Dev. Biol.-Plant. 35(6): 456-465 by means of particle bombardment. Agrobacteria-mediated transformations can be carried out for example by the method of Mlynarova et al. (1994), Plant Cell Report 13: 282-285.

Example 59: Lipid Extraction from Seeds

The effect of the genetic modification in plants on the production of a desired compound (such as a fatty acid) can be determined by growing the modified plant under suitable conditions (such as those described above) and analyzing the medium and/or the cellular components for the elevated production of the desired product (i.e. of the lipids or a fatty acid). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, pp 89-90 and pp 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", pp 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter 11, pp 1-27, VCH: Weinheim; and Dechow, F. J. (1989) Separation and purification techniques in biotechnology, Noyes Publications).

In addition to the abovementioned methods, plant lipids are extracted from plant material as described by Cahoon et al. (1999) Proc. Natl. Acad. Sci. USA 96 (22):12935-12940 and Browse et al. (1986) Analytic Biochemistry 152:141-145. The qualitative and quantitative analysis of lipids or fatty acids is described by Christie, William W., Advances in Lipid Methodology, Ayr/Scotland: Oily Press (Oily Press Lipid Library; 2); Christie, William W., Gas Chromatography and Lipids. A Practical Guide—Ayr, Scotland: Oily Press, 1989, Repr. 1992, IX, 307 pp (Oily Press Lipid Library; 1); "Progress in Lipid Research, Oxford: Pergamon Press, 1 (1952)-16 (1977) under the title: Progress in the Chemistry of Fats and Other Lipids CODEN.

In addition to measuring the end product of the fermentation, it is also possible to analyze other components of the metabolic pathways which are used for the production of the desired compound, such as intermediates and by-products, in order to determine the overall production efficiency of the compound. The analytical methods comprise measuring the amount of nutrients in the medium (for example sugars, hydrocarbons, nitrogen sources, phosphate and other ions), measuring the biomass composition and the growth, analyzing the production of conventional metabolites of biosynthetic pathways and measuring gases which are generated during the fermentation. Standard methods for these measurements are described in Applied Microbial Physiology; A Practical Approach, P. M. Rhodes and P. F. Stanbury, Ed., IRL Press, pp 103-129; 131-163 and 165-192 (ISBN: 0199635773) and references cited therein.

One example is the analysis of fatty acids (abbreviations: FAME, fatty acid methyl ester; GC-MS, gas liquid chromatography/mass spectrometry; TAG, triacylglycerol; TLC, thin-layer chromatography).

Unambiguous proof of the presence of fatty acid products can be obtained by analyzing recombinant organisms using standard analytical methods: GC, GC-MS or TLC, as described on several occasions by Christie and the references therein (1997, in: Advances on Lipid Methodology, Fourth Edition: Christie, Oily Press, Dundee, 119-169; 1998, Gaschromatographie-Massenspektrometrie-Verfahren [Gas chromatography/mass spectrometry methods], Lipide 33:343-353).

The material to be analyzed can be disrupted by sonication, grinding in a glass mill, liquid nitrogen and grinding or via other applicable methods. After disruption, the material must be centrifuged. The sediment is resuspended in distilled water, heated for 10 minutes at 100° C., cooled on ice and recentrifuged, followed by extraction for 1 hour at 90° C. in 0.5 M sulfuric acid in methanol with 2% dimethoxypropane, which leads to hydrolyzed oil and lipid compounds, which give transmethylated lipids. These fatty acid methyl esters are extracted in petroleum ether and finally subjected to a GC analysis using a capillary column (Chrompack, WCOT Fused Silica, CP-Wax-52 CB, 25 µm, 0.32 mm) at a temperature gradient of between 170° C. and 240° C. for 20 minutes and 5 minutes at 240° C. The identity of the resulting fatty acid methyl esters must be defined using standards which are available from commercial sources (i.e. Sigma).

Plant material is initially homogenized mechanically by crushing in a pestle and mortar to make it more amenable to extraction.

This is followed by heating at 100° C. for 10 minutes and, after cooling on ice, by resedimentation. The cell sediment is hydrolyzed for 1 hour at 90° C. with 1 M methanolic sulfuric acid and 2% dimethoxypropane, and the lipids are transmethylated. The resulting fatty acid methyl esters (FAMEs) are extracted in petroleum ether. The extracted FAMEs are analyzed by gas liquid chromatography using a capillary column (Chrompack, WCOT Fused Silica, CP-Wax-52 CB, 25 m, 0.32 mm) and a temperature gradient of from 170° C. to 240° C. in 20 minutes and 5 minutes at 240° C. The identity of the fatty acid methyl esters is confirmed by comparison with corresponding FAME standards (Sigma). The identity and position of the double bond can be analyzed further by suitable chemical derivatization of the FAME mixtures, for example to give 4,4-dimethoxyoxazolin derivatives (Christie, 1998) by means of GC-MS.

Example 60: Analysis of the Seeds from the Transgenic Plants which have been Generated Analogously to Example 59, the seeds of the plants which had been transformed with the constructs pGPTV-Cnl1_d6Des(Pir)_d5Des(Tc)_D6Elo(Pp)_D12Des(Co), pSUN-5G and pSUN-8G were analyzed. FIG. 32 shows the fatty acid spectrum of seeds with the construct pGPTV-Cnl1_d6Des(Pir)_d5Des(Tc)_D6Elo(Pp)_D12Des(Co). In comparison with control plants which were not transformed (wild-type control, WT), a pronounced change in the fatty acid spectrum was observed. It was thus possible to demonstrate that the transformed genes are functional. Table 22 compiles the results of FIG. 32.

TABLE 22

| Lines | \multicolumn{9}{c}{Fatty acids} | | | | | | | | |
|---|---|---|---|---|---|---|---|---|---|
| | 16:0 | 18:0 | 18:1 | 18:2 | GLA | 18:3 | SDA | ARA | EPA |
| WT control | 5.6 | 6.5 | 31.7 | 41.7 | nd | 12.1 | nd | nd | nd |
| 1424_Ko82_4 | 6.6 | 1.5 | 8.9 | 10.5 | 42.2 | 3.1 | 2.8 | 17.2 | 0.2 |
| 1424_Ko82_5 | 6.1 | 1.5 | 11.0 | 9.0 | 40.6 | 2.9 | 4.0 | 15.0 | 1.5 |
| 1424_Ko82_6 | 5.7 | 1.6 | 15.5 | 10.6 | 37.1 | 3.0 | 3.2 | 14.6 | 0.2 |
| 1424_Ko82_7 | 5.4 | 2.0 | 20.4 | 10.7 | 32.6 | 3.5 | 3.2 | 12.1 | 1.0 |
| 1424_Ko82_8 | 5.4 | 1.4 | 15.1 | 12.5 | 39.9 | 2.6 | 2.4 | 12.2 | 0.7 |
| 1424_Ko82_9 | 6.0 | 1.8 | 25.0 | 9.9 | 29.7 | 2.2 | 2.5 | 10.2 | 0.8 |
| 1424_Ko82_10 | 5.7 | 1.3 | 10.1 | 10.3 | 42.5 | 2.6 | 3.5 | 13.9 | 1.1 |
| 1424_Ko82_11 | 5.4 | 1.4 | 15.7 | 11.3 | 38.2 | 2.6 | 2.8 | 14.1 | 1.0 |

Here, the analysis of the seeds with the construct pSUN-5G reveals lines with a pronounced increase in the arachidonic acid content in comparison with the construct pGPTV-Cnl1_d6Des(Pir)_d5Des(Tc)_D6Elo(Pp)_D12Des(Co). In this context, lines with up to 25% ARA were obtained. The additional elongase (TL16y2) must be responsible for this effect (FIG. 31, pSUN-5G). The results from this line are compiled in Table 23.

TABLE 23

Fatty acid analysis of transgenic seeds which have been transformed with the construct pSUN-5G.

| Lines | Fatty acids | | | | | | | | | |
|---|---|---|---|---|---|---|---|---|---|---|
| | 16:0 | 18:0 | 18:1 | 18:2 LA | 18:3 GLA | 18:3 ALA | 18:4 SDA | 20:3 HGLA | ARA | EPA |
| WT | 5.2 | 2.3 | 34.2 | 37.9 | 0.0 | 11.6 | 0.0 | 0.0 | 0.0 | 0.0 |
| 16-1-2 | 4.2 | 1.6 | 20.1 | 21.5 | 25.9 | 4.1 | 1.8 | 1.7 | 8.9 | 0.8 |
| 16-1-3 | 5.8 | 2.3 | 9.9 | 14.6 | 33.6 | 3.1 | 2.2 | 2.2 | 16.0 | 1.4 |
| 16-1-8 | 5.0 | 2.8 | 11.1 | 12.6 | 34.9 | 2.2 | 1.8 | 2.6 | 16.3 | 1.2 |
| 16-2-1 | 4.9 | 1.6 | 14.5 | 17.4 | 32.9 | 3.5 | 2.0 | 1.6 | 12.3 | 1.0 |
| 16-2-5 | 5.5 | 3.3 | 12.9 | 13.8 | 32.9 | 2.9 | 2.2 | 1.4 | 15.4 | 1.4 |
| 16-4-2 | 5.8 | 2.5 | 18.8 | 14.7 | 32.0 | 3.5 | 2.3 | 1.2 | 12.0 | 1.2 |
| 16-4-3 | 5.9 | 2.0 | 19.7 | 15.0 | 32.0 | 3.8 | 2.4 | 1.1 | 11.4 | 1.2 |
| 16-7-2 | 6.2 | 4.4 | 14.3 | 10.2 | 30.7 | 2.0 | 2.1 | 1.7 | 19.4 | 1.9 |
| 16-7-3 | 5.0 | 2.5 | 21.6 | 13.6 | 30.7 | 2.1 | 1.8 | 1.5 | 12.6 | 1.1 |
| 16-7-4 | 5.3 | 4.1 | 18.8 | 19.5 | 23.1 | 4.2 | 2.2 | 2.9 | 11.3 | 1.4 |
| 16-7-5 | 7.4 | 1.8 | 4.2 | 6.8 | 33.7 | 1.8 | 2.7 | 2.6 | 25.8 | 2.6 |

Example 61: Detection of DHA in Seeds of Transgenic Indian Mustard Plants

Seeds of plants which had been generated with the construct pSUN-8G as described in Example 58 were analyzed as described in Example 59. Besides the LCPUFAs arachidonic acid and eicosapentaenoic acid, docosahexaenoic acid, the product after conversion by the Δ4-desaturase from *Thraustochytrium* and Δ5-elongases from *Onchorynchis mykiss* and *Ostreococcus tauri*, was also detected in these seeds. FIG. 32 shows the chromatogram with the modified fatty acid spectrum in comparison with an untransformed control plant. The results of several measurements are compiled in Table 24.

Table 24 shows the fatty acid analysis of transgenic seeds which have been transformed with the construct pSUN-8G.

In this experiment, the synthesis of docosahexaenoic acid in seeds was demonstrated for the first time. While the synthesis of DHA in higher plants has been described, for example in WO 2004/071467, the synthesis has not been demonstrated for seeds, only for an embryogenic cell culture.

EQUIVALENTS

Many equivalents of the specific embodiments according to the invention described herein can be seen or found by the skilled worker by simple routine experiments. These equivalents are intended to be included in the patent claims.

TABLE 2

Fatty acid distribution in the seeds of the three different transgenic *B. juncea* lines

| B. juncea lines | No. | 18:1 | 18:2 (LA) | γ18:3 (GLA) | α18:3 (ALA) | 18:4 (SDA) | 20:3 (HGLA) | 20:4 (ARA) |
|---|---|---|---|---|---|---|---|---|
| WT | 1 | 33.2 | 38.2 | 0 | 12.2 | 0 | 0 | 0 |
|  | 2 | 31.3 | 41.2 | 0 | 11.7 | 0 | 0 | 0 |
| 8-1424-5 | 1 | 25.1 | 12.8 | 26.4 | 3.5 | 2.4 | 0.6 | 8.3 |
|  | 2 | 26 | 12.7 | 26.3 | 3.8 | 2.6 | 0.6 | 8.2 |
|  | 3 | 25 | 12.5 | 25.9 | 3.4 | 2.4 | 0.8 | 8.5 |
| 8-1424-8 | 1 | 28.1 | 13.1 | 25 | 5.8 | 3.7 | 0.2 | 6.2 |
|  | 2 | 24.7 | 14.8 | 26.4 | 5.2 | 3 | 0.3 | 6.8 |
| 8-1424-10 | 1 | 25.2 | 14.2 | 29.8 | 5.2 | 3.4 | 0.5 | 5 |
|  | 2 | 27.2 | 12.7 | 27.9 | 4.2 | 2.9 | 0.3 | 6.3 |

The amounts of fatty acids were stated in % by weight.

LA = linoleic acid,

GLA = γ-linolenic acid,

ALA = α-linolenic acid,

SDA = stearidonic acid,

HGLA = dihomo-γ-linolenic acid,

ARA = arachidonic acid,

ETA = eicosatetraenoic acid,

EPA = eicosapentaenoic acid

TABLE 3

Fatty acid distribution in the seeds of the three different transgenic *B. juncea* lines

| Sample | No. | 18:1 Δ9 | 18:2 Δ6, 9 | 18:2 Δ9, 12 (LA) | 18:3 Δ6, 9, 12 (GLA) | 18:3 Δ9, 12, 15 (ALA) | 18:4 Δ6, 9, 12, 15 (SDA) | 20:3 Δ8, 11, 14 (HGLA) | 20:4 Δ5, 8, 11, 14 (ARA) | 20:4 Δ8, 11, 14, 17 (ETA) | 20:5 Δ5, 8, 11, 14, 17 (EPA) |
|---|---|---|---|---|---|---|---|---|---|---|---|
| WT | 1 | 35.10 | 0.00 | 35.71 | 0.00 | 10.80 | 0.00 | 0.00 | 0.00 | 0.00 | 0.00 |
|  | 2 | 27.79 | 0.00 | 32.83 | 0.00 | 8.94 | 0.71 | 0.00 | 0.00 | 0.00 | 0.00 |
| 9-1424-1 | 1 | 17.62 | 1.07 | 12.32 | 29.92 | 2.84 | 2.17 | 0.97 | 13.05 | <0.01 | 1.21 |
|  | 2 | 23.68 | 2.17 | 10.57 | 23.70 | 2.39 | 1.80 | 0.98 | 11.60 | <0.01 | 1.16 |
|  | 3 | 17.15 | 0.94 | 12.86 | 31.16 | 3.19 | 2.40 | 1.01 | 12.09 | <0.01 | 1.16 |
| 9-1424-5 | 1 | 16.48 | 1.47 | 11.09 | 30.49 | 3.06 | 2.56 | 0.75 | 11.84 | <0.01 | 1.24 |
|  | 2 | 17.70 | 1.23 | 11.42 | 27.94 | 2.35 | 1.88 | 0.64 | 12.30 | 0.03 | 1.12 |
|  | 3 | 19.29 | 1.05 | 10.95 | 26.11 | 2.85 | 2.11 | 1.07 | 12.09 | <0.01 | 1.21 |
| 9-1424-6 | 1 | 24.71 | 0.00 | 41.87 | 0.00 | 12.32 | 0.00 | 0.00 | 0.00 | 0.00 | 0.00 |
|  | 2 | 28.84 | 0.00 | 40.65 | 0.00 | 10.94 | 0.00 | 0.00 | 0.00 | 0.00 | 0.00 |
|  | 3 | 29.28 | 0.00 | 41.34 | 0.00 | 10.76 | 0.00 | 0.00 | 0.00 | 0.00 | 0.00 |
| 9-1424-7 | 1 | 32.41 | 0.00 | 37.26 | 0.00 | 10.05 | 0.00 | 0.00 | 0.00 | 0.00 | 0.00 |
|  | 2 | 27.76 | 0.00 | 36.66 | 0.00 | 11.43 | 0.00 | 0.00 | 0.00 | 0.00 | 0.00 |
|  | 3 | 32.03 | 0.00 | 36.27 | 0.00 | 9.27 | 0.00 | 0.00 | 0.00 | 0.00 | 0.00 |
| 9-1424-8 | 1 | 19.08 | 0.61 | 11.26 | 23.31 | 3.73 | 2.14 | 1.11 | 10.93 | 0.08 | 1.11 |
|  | 2 | 20.34 | 3.78 | 10.07 | 19.59 | 2.36 | 1.72 | 0.68 | 8.21 | <0.01 | 1.00 |
|  | 3 | 28.27 | 0.00 | 37.19 | 0.00 | 9.32 | 0.00 | 0.00 | 0.00 | 0.00 | 0.00 |

TABLE 3-continued

Fatty acid distribution in the seeds of the three different transgenic *B. juncea* lines

| Sample | No. | 18:1 Δ9 | 18:2 Δ6, 9 | 18:2 Δ9, 12 (LA) | 18:3 Δ6, 9, 12 (GLA) | 18:3 Δ9, 12, 15 (ALA) | 18:4 Δ6, 9, 12, 15 (SDA) | 20:3 Δ8, 11, 14 (HGLA) | 20:4 Δ5, 8, 11, 14 (ARA) | 20:4 Δ8, 11, 14, 17 (ETA) | 20:5 Δ5, 8, 11, 14, 17 (EPA) |
|---|---|---|---|---|---|---|---|---|---|---|---|
| 9-1424-9 | 1 | 25.95 | 0.00 | 37.87 | 0.00 | 9.15 | 0.00 | 0.00 | 0.00 | 0.00 | 0.00 |
| | 2 | 22.94 | 0.00 | 42.69 | 0.00 | 9.14 | 0.00 | 0.00 | 0.00 | 0.00 | 0.00 |
| | 3 | 18.96 | 0.61 | 14.09 | 23.76 | 3.17 | 1.86 | 0.97 | 10.46 | <0.01 | 0.94 |

The amounts of fatty acids were stated in % by weight.
LA = linoleic acid,
GLA = γ-linolenic acid,
ALA = α-linolenic acid,
SDA = stearidonic acid,
HGLA = dihomo-γ-linolenic acid,
ARA = arachidonic acid,
ETA = eicosatetraenoic acid,
EPA = eicosapentaenoic acid

TABLE 4

Fatty acid analysis in seeds of *Brassica juncea*

| | 16:0 | 18:0 | 18:1c9 | 18:1c11 | 18:2c6, 9 | LA 18:2 | GLA 18:3 | ALA 18:3 | SDA 18:4 | 20:0 | 20:1c5 | 20:2 c8, 11 | HGLA 20:3 c8, 11, 14 | ARA 20:4 | ETA 20:4 | EPA 20:5 |
|---|---|---|---|---|---|---|---|---|---|---|---|---|---|---|---|---|
| WT | 5.2 | 2.3 | 34.2 | 3.2 | 0.0 | 37.9 | 0.0 | 11.6 | 0.0 | 0.4 | 1.1 | 3.7 | 0.0 | 0.0 | 0.0 | 0.0 |
| 16-1-2 | 4.2 | 1.6 | 20.1 | 2.3 | 0.1 | 21.5 | 25.9 | 4.1 | 1.8 | 0.4 | 1.5 | 3.9 | 1.7 | 8.9 | 0.5 | 0.8 |
| 16-1-3 | 5.8 | 2.3 | 9.9 | 2.7 | 0.1 | 14.6 | 33.6 | 3.1 | 2.2 | 0.6 | 1.0 | 3.2 | 2.2 | 16.0 | 0.4 | 1.4 |
| 16-1-8 | 5.0 | 2.8 | 11.1 | 2.1 | 0.3 | 12.6 | 34.9 | 2.2 | 1.8 | 0.6 | 1.3 | 3.7 | 2.6 | 16.3 | 0.4 | 1.2 |
| 16-2-1 | 4.9 | 1.6 | 14.5 | 2.9 | 0.2 | 17.4 | 32.9 | 3.5 | 2.0 | 0.4 | 0.9 | 1.6 | 1.6 | 12.3 | 1.9 | 1.0 |
| 16-2-5 | 5.5 | 3.3 | 12.9 | 3.0 | 0.4 | 13.8 | 32.9 | 2.9 | 2.2 | 0.7 | 1.0 | 2.2 | 1.4 | 15.4 | 0.3 | 1.4 |
| 16-4-2 | 5.8 | 2.5 | 18.8 | 2.6 | 0.9 | 14.7 | 32.0 | 3.5 | 2.3 | 0.7 | 0.8 | 0.6 | 1.2 | 12.0 | 0.1 | 1.2 |
| 16-4-3 | 5.9 | 2.0 | 19.7 | 2.5 | 1.1 | 15.0 | 32.0 | 3.8 | 2.4 | 0.5 | 0.8 | 0.5 | 1.1 | 11.4 | 0.1 | 1.2 |
| 16-7-2 | 6.2 | 4.4 | 14.3 | 2.2 | 0.7 | 10.2 | 30.7 | 2.0 | 2.1 | 0.9 | 0.9 | 2.1 | 1.7 | 19.4 | 0.3 | 1.9 |
| 16-7-3 | 5.0 | 2.5 | 21.6 | 1.7 | 1.5 | 13.6 | 30.7 | 2.1 | 1.8 | 0.6 | 1.1 | 2.0 | 1.5 | 12.6 | 0.2 | 1.1 |
| 16-7-4 | 5.3 | 4.1 | 18.8 | 2.2 | 0.7 | 19.5 | 23.1 | 4.2 | 2.2 | 0.7 | 1.0 | 1.8 | 2.9 | 11.3 | 0.3 | 1.4 |
| 16-7-5 | 7.4 | 1.8 | 4.2 | 3.9 | 0.0 | 6.8 | 33.7 | 1.8 | 2.7 | 0.8 | 0.8 | 3.2 | 2.6 | 25.8 | 0.6 | 2.6 |

The amounts of fatty acids were stated in % by weight.
LA = linoleic acid,
GLA = γ-linolenic acid,
ALA = α-linolenic acid,
SDA = stearidonic acid,
HGLA = dihomo-γ-linolenic acid,
ARA = arachidonic acid,
ETA = eicosatetraenoic acid,
EPA = eicosapentaenoic acid

TABLE 6

Conversion rates of the fatty acids which have been fed. The conversion rates were calculated using the formula [conversion rate] = [product]/[[substrate] + [product]] * 100
BioTaur clones area in % of the GC analysis

| Clone | fatty acid | C16:0 | C16:1 (n-7) | C18:0 | C18:1 (n-9) | C18:3 (n-6) | C18:4 (n-3) | C20:3 (n-6) | C20:4 (n-6) | C20:4 (n-3) | C20:5 (n-3) | C22:4 (n-6) | C22:4 (n-3) | C22:5 (n-3) |
|---|---|---|---|---|---|---|---|---|---|---|---|---|---|---|
| Vector | none | 21.261 | 41.576 | 4.670 | 25.330 | | | | | | | | | |
| BioTaur | none | 20.831 | 37.374 | 4.215 | 26.475 | | | | | | | | | |
| Vector | GLA + EPA | 22.053 | 23.632 | 5.487 | 17.289 | 11.574 | | | | | 13.792 | | | |
| BioTaur | GLA + EPA | 20.439 | 25.554 | 6.129 | 19.587 | 3.521 | | 6.620 | | | 10.149 | | | 1.127 |
| Vector | EPA | 20.669 | 28.985 | 6.292 | 21.712 | | | | | | 16.225 | | | |
| BioTaur | EPA | 20.472 | 26.913 | 6.570 | 23.131 | | | | | | 11.519 | | | 3.251 |
| Vector | ARA | 23.169 | 23.332 | 6.587 | 12.735 | | | | 27.069 | | | | | |
| BioTaur | ARA | 20.969 | 31.281 | 5.367 | 21.351 | | | | 9.648 | | | 1.632 | | |
| Vector | SDA | 18.519 | 12.626 | 6.642 | 6.344 | | 47.911 | | | | | | | |
| BioTaur | SDA | 19.683 | 15.878 | 7.246 | 8.403 | | 13.569 | | | 25.946 | | | 0.876 | |

TABLE 24

Fatty acid analysis of transgenic seeds which have been transformed with the construct pSUN-8G

| I | 16:0 | 18:0 | 18:1 Δ9 | LA 18:2 Δ9, 12 | GLA 18:3 Δ6, 9, 12 | ALA 18:3 Δ9, 12, 15 | SDA 18:4 Δ6, 9, 12, 15 | HGLA 20:3 Δ8, 11, 14 | ARA 20:4 Δ5, 8, 11, 14 | EPA 20:5 Δ5, 8, 11, 14, 17 | 22:5 Δ7, 10, 13, 16, 19 | DHA 22:6 Δ4, 7, 10, 13, 16, 19 |
|---|---|---|---|---|---|---|---|---|---|---|---|---|
| WT | 5.26 | 1.80 | 30.78 | 43.93 | nd | 12.47 | nd | nd | nd | nd | nd | nd |
| Bj-17-1-3 | 4.73 | 2.28 | 19.30 | 14.04 | 31.48 | 3.09 | 2.40 | 1.70 | 3.37 | 8.65 | 0.19 | 0.25 |
| Bj-17-2-1 | 4.34 | 2.17 | 17.60 | 15.56 | 29.97 | 3.37 | 2.44 | 2.14 | 4.05 | 9.14 | 0.23 | 0.40 |
| Bj-17-4-3 | 4.31 | 1.70 | 14.45 | 16.94 | 35.54 | 3.43 | 2.39 | 0.10 | 5.09 | 9.43 | 0.24 | 0.23 |

| II | % saturated fatty acids | % mono-unsaturated fatty acids | % poly-unsaturated fatty acids | % LCFAs | % VLCFAs |
|---|---|---|---|---|---|
| WT | 7.96 | 35.43 | 56.62 | 97.71 | 2.29 |
| Bj-17-1-3 | 9.18 | 24.95 | 65.87 | 79.64 | 20.36 |
| Bj-17-2-1 | 9.83 | 25.44 | 64.73 | 80.44 | 19.56 |
| Bj-17-4-3 | 14.05 | 20.36 | 65.60 | 75.27 | 24.73 |

LCFAs = all fatty acids up to a length of 18 carbon atoms in the fatty acid chain
VLCFAs = all fatty acids with a length of 20 or more carbon atoms in the fatty acid chain

SEQUENCE LISTING (255 sequences)

SEQ ID NO: 1 - DNA, 1266 bp, Euglena gracilis
  CDS (1)..(1266): Delta-8 desaturase
atgaagtcaaagcgccaagcgcttccccttacaattgatggaacaacatatgatgtgtctgcctgggtcaatttccaccctggtggtgcggaaattatagagaattaccaaggaagggatgccactgatgccttcatggttatgcactctcaagaagccttcgacaagctcaagcgcatgcccaaaatcaatcccagttctgagttgccaccccaggctgcagtgaatgaagctcaagaggatttccggaagctccgagaagagttgatcgcaactggcatgtttgatgcctcccccctctggtactcatacaaaatcagcaccacactgggccttggagtgctgggttatttcctgatggttcagtatcagatgtatttcattggggcagtgttgcttgggatgcactatcaacagatgggctggctttctcatgacatttgccaccaccagactttcaagaaccggaactggaacaacctcgtgggactggtatttggcaatggtctgcaaggtttttccgtgacatgctggaaggacagacacaatgcacatcattcggcaaccaatgttcaagggcacgaccctgatattgacaacctccccctcttagcctggtctgaggatgacgtcacacgggcgtcaccgatttcccgcaagctcattcagttccagcagtattatttcttggtcatctgtatcttgttgcggttcatttggtgtttccagagcgtgttgaccgtgcgcagtctgaaggacagagataaccaattctatcgctctcagtataagaaggaggccattggcctcgccctgcattggacattgaaggccctgttccacttattctttatgcccagcatcctcacatcgctgttggtatttttcgtttcggagctggttggcggcttcggcattgcgatcgtggtgttcatgaaccactacccactggagaagatcggggactcggtctgggatggccatggattctcggttggccagatccatgagaccatgaacattcggcgagggattatcacagattggtttttcggaggcttgaactaccagatcgagcaccatttgtggccgaccctccctcgccacaacctgacagcggttagctaccaggtggaacagctgtgccagaagcacaacctgccgtatcggaacccgctgccccatgaagggttggtcatcctgctgcgctatctggcggtgttcgcccggatggcggagaagcaacccgcggggaaggctctataa

SEQ ID NO: 2 - protein, 421 aa, Euglena gracilis
MKSKRQALPLTIDGTTYDVSAWVNFHPGGAEIIENYQGRDATDAFMVMHSQEAFDKLKRMPKINPSSELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTCWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKALFHLFFMPSILTSLLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 3 - DNA, 777 bp, Isochrysis galbana
  CDS (1)..(777): Delta-9 elongase
atggccctcgcaaacgacgcgggagagcgcatctgggcggctgtgaccgacccggaaatcctcattggcaccttctcgtacttgctactcaaaccgctgctccgcaattccgggctggtggatgagaagaagggcgcatacaggacgtccatgatctggtacaacgttctgctggcgctcttctctgcgctgagcttctacgtgacggcgaccgccctcggctgggactatggtacgggcgcgtggctgcgcaggcaaaccggcgacacaccgcagccgctcttccagtgcccgtccccggtttgggactcgaagctcttcacatggaccgccaaggcattctattactccaagtacgtggagtacctcgacacggcctggctgagggtctcctttctccaggccttccaccactttggcgcgccgtgggatgtgtacctcggcattcggctgcacaacgagggcgtatggatcttcatgtttttcaactcgttcattcacaccatcatgtacacctactacggcctcaccgccgccgggtataagttcaaggccaagccgctcatcaccgcgatgcagatctgccagttcgtgggcggcttcctgttggtctgggactacatcaacgtcccctgcttcaactcggacaaagggaagttgttcagctgggctttcaactatgcatacgtcggctcggtcttcttgctcttctgccactttttctaccaggacaacttggcaacgaagaaatcggccaaggcgggcaagcagctctag

SEQ ID NO: 4 - protein, 258 aa, Isochrysis galbana
MALANDAGERIWAAVTDPEILIGTFSYLLLKPLLRNSGLVDEKKGAYRTSMIWYNVLLALFSALSFYVTATALGWDYGTGAWLRRQTGDTPQPLFQCPSPVWDSKLFTWTAKAFYYSKYVEYLDTAWLRVSFLQAFHHFGAPWDVYLGIRLHNEGVWIFMFFNSFIHTIMYTYYGLTAAGYKFKAKPLITAMQICQFVGGFLLVWDYINVPCFNSDKGKLFSWAFNYAYVGSVFLLFCHFFYQDNLATKKSAKAGKQL

SEQ ID NO: 5 - DNA, 1410 bp, Phaeodactylum tricornutum
  CDS (1)..(1410): Delta-5 desaturase
atggctccggatgcggataagcttcgacaacgccagacgactgcggtagcgaagcacaatgctgctaccatatcgacgcaggaacgcctttgcagtctgtcttcgctcaaaggcgaagaagtctgcatcgacggaatcatctatgacctccaatcattcgatcatcccgggggtgaaacgatcaaaatgtttggtggcaacgatgtcactgtacagtacaagatgattcacccgtaccataccgagaagcatttggaaaagatgaagcgtgtcggcaaggtgacggatttcgtctgcgagtacaagttcgataccgaatttgaacgcgaaatcaaacgagaagtcttcaagattgtgcgacgaggcaaggatttcggtactttgggatggttcttccgtgcgttttgctacattgccattttcttctacctgcagtaccattgggtcaccacgggaacctcttggctgctggccgtggcctacggaatctcccaagcgatgattggcatgaatgtccagcacgatgccaaccacggggccacctccaagcgtccctgggtcaacgacatgctaggcctcggtgcggattttattggtggttccaagtggctctggcaggaacaacactggacccaccacgcttacaccaatcacgccgagatggatcccgatagctttggtgccgaaccaatgctcctattcaacgactatcccttggatcatcccgctcgtacctggctacatcgctttcaagcattcttttacatgcccgtcttggctggatactggttgtccgctgtcttcaatccacaaattcttgacctccagcaacgcggcgcactttccgtcggtatccgtctcgacaacgctttcattcactcgcgacgcaagtatgcggttttctggcgggctgtgtacattgcggtgaacgtgattgctccgttttacacaaactccggcctcgaatggtcctggcgtgtctttggaaacatcatgctcatgggtgtggcggaatcgctcgcgctggcggtcctgttttcgttgtcgcacaatttcgaatccgcggatcgcgatccgaccgccccactgaaaaagacgggagaaccagtcgactggttcaagacacaggtcgaaacttcctgcacttacggtggattcctttccggttgcttcacgggaggtctcaactttcaggttgaacaccacttgttcccacgcatgagcagcgcttggtatccctacattgcccccaaggtccgcgaaatttgcgccaaacacggcgtccactacgcctactacccgtggatccaccaaaactttctctccaccgtccgctacatgcacgcggccgggaccggtgccaactggcgccagatggccagagaaaatcccttgaccggacgggcgtaa

SEQ ID NO: 6 - protein, 469 aa, Phaeodactylum tricornutum
MAPDADKLRQRQTTAVAKHNAATISTQERLCSLSSLKGEEVCIDGIIYDLQSFDHPGGETIKMFGGNDVTVQYKMIHPYHTEKHLEKMKRVGKVTDFVCEYKFDTEFEREIKREVFKIVRRGKDFGTLGWFFRAFCYIAIFFYLQYHWVTTGTSWLLAVAYGISQAMIGMNVQHDANHGATSKRPWVNDMLGLGADFIGGSKWLWQEQHWTHHAYTNHAEMDPDSFGAEPMLLFNDYPLDHPARTWLHRFQAFFYMPVLAGYWLSAVFNPQILDLQQRGALSVGIRLDNAFIHSRRKYAVFWRAVYIAVNVIAPFYTNSGLEWSWRVFGNIMLMGVAESLALAVLFSLSHNFESADRDPTAPLKKTGEPVDWFKTQVETSCTYGGFLSGCFTGGLNFQVEHHLFPRMSSAWYPYIAPKVREICAKHGVHYAYYPWIHQNFLSTVRYMHAAGTGANWRQMARENPLTGRA

SEQ ID NO: 7 - DNA, 1344 bp, Ceratodon purpureus
  CDS (1)..(1344): Delta-5 desaturase
atggtattacgagagcaagagcatgagccattcttcattaaaattgatggaaaatggtgtcaaattgacgatgctgtcctgagatcacatccaggtggtagtgcaattactacctataaaaatatggatgccactaccgtattccacacattccatactggttctaaagaagcgtatcaatggctgacagaattgaaaaaagagtgccctacacaagaaccagagatcccagatattaaggatgacccaatcaaaggaattgatgatgtgaacatgggaactttcaatatttctgagaaacgatctgcccaaataaataaaagtttcactgatctacgtatgcgagttcgtgcagaaggacttatggatggatctcctttgttctacattagaaaaattcttgaaacaatcttcacaattctttttgcattctaccttcaataccacacatattatcttccatcagctattctaatgggagttgcgtggcaacaattgggatggttaatccatgaattcgcacatcatcagttgttcaaaaacagatactacaatgatttggccagctatttcgttggaaactttttacaaggattctcatctggtggttggaaagagcagcacaatgtgcatcacgcagccacaaatgttgttggacgagacggagatcttgatttagtcccattctatgctacagtggcagaacatctcaacaattattctcaggattcatgggttatgactctattcagatggcaacatgttcattggacattcatgttaccattcctccgtctctcgtggcttcttcagtcaatcatttttgttagtcagatgccaactcattattatgactattacagaaatactgcgatttatgaacaggttggtctctctttgcactgggcttggtcattgggtcaattgtatttcctacccgattggtcaactagaataatgttcttccttgtttctcatcttgttggaggtttcctgctctctcatgtagttactttcaatcattattcagtggagaagtttgcattgagctcgaacatcatgtcaaattacgcttgtcttcaaatcatgaccacaagaaatatgagacctggaagattcattgactggctttggggaggtcttaactatcagattgagcaccatcttttcccaacgatgccacgacacaacttgaacactgttatgccacttgttaaggagtttgcagcagcaaatggtttaccatacatggtcgacgattatttcacaggattctggcttgaaattgagcaattccgaaatattgcaaatgttgctgctaaattgactaaaaagattgcctag

SEQ ID NO: 8 - protein, 447 aa, Ceratodon purpureus
MVLREQEHEPFFIKIDGKWCQIDDAVLRSHPGGSAITTYKNMDATTVFHTFHTGSKEAYQWLTELKKECPTQEPEIPDIKDDPIKGIDDVNMGTFNISEKRSAQINKSFTDLRMRVRAEGLMDGSPLFYIRKILETIFTILFAFYLQYHTYYLPSAILMGVAWQQLGWLIHEFAHHQLFKNRYYNDLASYFVGNFLQGFSSGGWKEQHNVHHAATNVVGRDGDLDLVPFYATVAEHLNNYSQDSWVMTLFRWQHVHWTFMLPFLRLSWLLQSIIFVSQMPTHYYDYYRNTAIYEQVGLSLHWAWSLGQLYFLPDWSTRIMFFLVSHLVGGFLLSHVVTFNHYSVEKFALSSNIMSNYACLQIMTTRNMRPGRFIDWLWGGLNYQIEHHLFPTMPRHNLNTVMPLVKEFAAANGLPYMVDDYFTGFWLEIEQFRNIANVAAKLTKKIA

SEQ ID NO: 9 - DNA, 1443 bp, Physcomitrella patens
  CDS (1)..(1443): Delta-5 desaturase
atggcgccccactctgcggatactgctgggctcgtgccttctgacgaattgaggctacgaacgtcgaattcaaagggtcccgaacaagagcaaactttgaagaagtacacccttgaagatgtcagccgccacaacaccccagcagattgttggttggtgatatggggcaaagtctacgatgtcacaagctggattcccaatcatccggggggcagtctcatccacgtaaaagcagggcaggattccactcagcttttcgattcctatcaccccctttatgtcaggaaaatgctcgcgaagtactgtattggggaattagtaccgtctgctggtgatgacaagtttaagaaagcaactctggagtatgcagatgccgaaaatgaagatttctatttggttgtgaagcaacgagttgaatcttatttcaagagtaacaagataaacccccaaattcatccacatatgatcctgaagtcattgttcattcttgggggatatttcgccagttactatttagcgttcttctggtcttcaagtgtccttgtttctttgtttttcgcattgtggatggggttcttcgcagcggaagtcggcgtgtcgattcaacatgatggaaatcatggttcatacactaaatggcgtggctttggatatatcatgggagcctccctagatctagtcggagccagtagcttcatgtggagacagcaacacgttgtgggacatcactcgtttacaaatgtggacaactacgatcctgatattcgtgtgaaagatccagatgtcaggagggttgcgaccacacaaccaagacaatggtatcatgcgtatcagcatatctacctggcagtattatatggaactctagctcttaagagtatttttctagatgatttccttgcgtacttcacaggatcaattggccctgtcaaggtggcgaaaatgacccccctggagttcaacatcttctttcagggaaagctgctatatgcgttctacatgttcgtgttgccatctgtgtacggtgttcactccggaggaactttcttggcactatatgtggcttctcagctcattacaggttggatgttagcttttctttttcaagtagcacatgtcgtggatgatgttgcatttcctacaccagaaggtgggaaggtgaagggaggatgggctgcaatgcaggttgcaacaactacggatttcagtccacgctcatggttctggggtcatgtctctggaggattaaacaaccaaattgagcatcatctgtttccaggagtgtgccatgttcattatccagccattcagcctattgtcgagaagacgtgcaaggaattcgatgtgccttatgtagcctacccaactttttggactgcgttgagagcccactttgcgcatttgaaaaaggttggattgacagagtttcggctcgatggctga

SEQ ID NO: 10 - protein, 480 aa, Physcomitrella patens
MAPHSADTAGLVPSDELRLRTSNSKGPEQEQTLKKYTLEDVSRHNTPADCWLVIWGKVYDVTSWIPNHPGGSLIHVKAGQDSTQLFDSYHPLYVRKMLAKYCIGELVPSAGDDKFKKATLEYADAENEDFYLVVKQRVESYFKSNKINPQIHPHMILKSLFILGGYFASYYLAFFWSSSVLVSLFFALWMGFFAAEVGVSIQHDGNHGSYTKWRGFGYIMGASLDLVGASSFMWRQQHVVGHHSFTNVDNYDPDIRVKDPDVRRVATTQPRQWYHAYQHIYLAVLYGTLALKSIFLDDFLAYFTGSIGPVKVAKMTPLEFNIFFQGKLLYAFYMFVLPSVYGVHSGGTFLALYVASQLITGWMLAFLFQVAHVVDDVAFPTPEGGKVKGGWAAMQVATTTDFSPRSWFWGHVSGGLNNQIEHHLFPGVCHVHYPAIQPIVEKTCKEFDVPYVAYPTFWTALRAHFAHLKKVGLTEFRLDG

SEQ ID NO: 11 - DNA, 1320 bp, Thraustrochytrium
  CDS (1)..(1320): Delta-5-Desaturase
atgggcaagggcagcgagggccgcagcgcggcgcgcgagatgacggccgaggcgaacggcgacaagcggaaaacgattctgatcgagggcgtcctgtacgacgcgacgaactttaagcacccgggcggttcgatcatcaacttcttgaccgagggcgaggccggcgtggacgcgacgcaggcgtaccgcgagtttcatcagcggtccggcaaggccgacaagtacctcaagtcgctgccgaagctggatgcgtccaaggtggagtcgcggttctcggccaaagagcaggcgcggcgcgacgccatgacgcgcgactacgcggcctttcgcgaggagctcgtcgccgaggggtactttgacccgtcgatcccgcacatgatttaccgcgtcgtggagatcgtggcgctcttcgcgctctcgttctggctcatgtccaaggcctcgcccacctcgctcgtgctgggcgtggtgatgaacggcattgcgcagggccgctgcggctgggtcatgcacgagatgggccacgggtcgttcacgggcgtcatctggctcgacgaccggatgtgcgagttcttctacggcgtcggctgcggcatgagcgggcactactggaagaaccagcacagcaagcaccacgccgcgcccaaccgcctcgagcacgatgtcgatctcaacacgctgcccctggtcgcctttaacgagcgcgtcgtgcgcaaggtcaagccgggatcgctgctggcgctctggctgcgcgtgcaggcgtacctctttgcgcccgtctcgtgcctgctcatcggccttggctggacgctctacctgcacccgcgctacatgctgcgcaccaagcggcacatggagttcgtctggatcttcgcgcgctacattggctggttctcgctcatgggcgctctcggctactcgccgggcacctcggtcgggatgtacctgtgctcgttcggcctcggctgcatttacattttcctgcagttcgccgtcagccacacgcacctgccggtgaccaacccggaggaccagctgcactggctcgagtacgcggccgaccacacggtgaacattagcaccaagtcctggctcgtcacgtggtggatgtcgaacctgaactttcagatcgagcaccacctcttccccacggcgccgcagttccgcttcaaggaaatcagtcctcgcgtcgaggccctcttcaagcgccacaacctcccgtactacgacctgccctacacgagcgcggtctcgaccacctttgccaatctttattccgtcggccactcggtcggcgccgacaccaagaagcaggactga

SEQ ID NO: 12 - protein, 439 aa, Thraustrochytrium
MGKGSEGRSAAREMTAEANGDKRKTILIEGVLYDATNFKHPGGSIINFLTEGEAGVDATQAYREFHQRSGKADKYLKSLPKLDASKVESRFSAKEQARRDAMTRDYAAFREELVAEGYFDPSIPHMIYRVVEIVALFALSFWLMSKASPTSLVLGVVMNGIAQGRCGWVMHEMGHGSFTGVIWLDDRMCEFFYGVGCGMSGHYWKNQHSKHHAAPNRLEHDVDLNTLPLVAFNERVVRKVKPGSLLALWLRVQAYLFAPVSCLLIGLGWTLYLHPRYMLRTKRHMEFVWIFARYIGWFSLMGALGYSPGTSVGMYLCSFGLGCIYIFLQFAVSHTHLPVTNPEDQLHWLEYAADHTVNISTKSWLVTWWMSNLNFQIEHHLFPTAPQFRFKEISPRVEALFKRHNLPYYDLPYTSAVSTTFANLYSVGHSVGADTKKQD

SEQ ID NO: 13 - DNA, 1341 bp, Mortierella alpina
  CDS (1)..(1341): Delta-5 desaturase
atgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtag

SEQ ID NO: 14 - protein, 446 aa, Mortierella alpina
MGTDQGKTFTWEELAAHNTKDDLLLAIRGRVYDVTKFLSRHPGGVDTLLLGAGRDVTPVFEMYHAFGAADAIMKKYYVGTLVSNELPIFPEPTVFHKTIKTRVEGYFTDRNIDPKNRPEIWGRYALIFGSLIASYYAQLFVPFVVERTWLQVVFAIIMGFACAQVGLNPLHDASHFSVTHNPTVWKILGATHDFFNGASYLVWMYQHMLGHHPYTNIAGADPDVSTSEPDVRRIKPNQKWFVNHINQHMFVPFLYGLLAFKVRIQDINILYFVKTNDAIRVNPISTWHTVMFWGGKAFFVWYRLIVPLQYLPLGKVLLLFTVADMVSSYWLALTFQANHVVEEVQWPLPDENGIIQKDWAAMQVETTQDYAHDSHLWTSITGSLNYQAVHHLFPNVSQHHYPDILAIIKNTCSEYKVPYLVKDTFWQAFASHLEHLRVLGLRPKEE

SEQ ID NO: 15 - DNA, 1344 bp, Caenorhabditis elegans; identical to SEQ ID NO: 7
  CDS (1)..(1344): Delta-5 desaturase

SEQ ID NO: 16 - protein, 447 aa, Caenorhabditis elegans; identical to SEQ ID NO: 8

SEQ ID NO: 17 - DNA, 1683 bp, Borago officinalis
  CDS (42)..(1388): Delta-6 desaturase
tatctgcctaccctcccaaagagagtagtcatttttcatcaatggctgctcaaatcaagaaatacattacctcagatgaactcaagaaccacgataaacccggagatctatggatctcgattcaagggaaagcctatgatgtttcggattgggtgaaagaccatccaggtggcagctttcccttgaagagtcttgctggtcaagaggtaactgatgcatttgttgcattccatcctgcctctacatggaagaatcttgataagtttttcactgggtattatcttaaagattactctgtttctgaggtttctaaagattataggaagcttgtgtttgagttttctaaaatgggtttgtatgacaaaaaaggtcatattatgtttgcaactttgtgctttatagcaatgctgtttgctatgagtgtttatggggttttgttttgtgagggtgttttggtacatttgttttctgggtgtttgatggggtttctttggattcagagtggttggattggacatgatgctgggcattatatggtagtgtctgattcaaggcttaataagtttatgggtatttttgctgcaaattgtctttcaggaataagtattggttggtggaaatggaaccataatgcacatcacattgcctgtaatagccttgaatatgaccctgatttacaatatataccattccttgttgtgtcttccaagttttttggttcactcacctctcatttctatgagaaaaggttgacttttgactctttatcaagattctttgtaagttatcaacattggacattttaccctattatgtgtgctgctaggctcaatatgtatgtacaatctctcataatgttgttgaccaagagaaatgtgtcctatcgagctcaggaactcttgggatgcctagtgttctcgatttggtacccgttgcttgtttcttgtttgcctaattggggtgaaagaattatgtttgttattgcaagtttatcagtgactggaatgcaacaagttcagttctccttgaaccacttctcttcaagtgtttatgttggaaagcctaaagggaataattggtttgagaaacaaacggatgggacacttgacatttcttgtcctccttggatggattggtttcatggtggattgcaattccaaattgagcatcatttgtttcccaagatgcctagatgcaaccttaggaaaatctcgccctacgtgatcgagttatgcaagaaacataatttgccttacaattatgcatctttctccaaggccaatgaaatgacactcagaacattgaggaacacagcattgcaggctagggatataaccaagccgctcccgaagaatttggtatgggaagctcttcacactcatggttaaaattacccttagttcatgtaataatttgagattatgtatctcctatgtttgtgtcttgtcttggttctacttgttggagtcattgcaacttgtcttttatggtttattagatgttttttaatatattttagaggttttgctttcatctccattattgatgaataaggagttgcatattgtcaattgttgtgctcaatatctgatattttggaatgtactttgtaccactgtgttttcagttgaagctcatgtgtacttctatagactttgtttaaatggttatgtcatgttattt

SEQ ID NO: 18 - protein, 448 aa, Borago officinalis
MAAQIKKYITSDELKNHDKPGDLWISIQGKAYDVSDWVKDHPGGSFPLKSLAGQEVTDAFVAFHPASTWKNLDKFFTGYYLKDYSVSEVSKDYRKLVFEFSKMGLYDKKGHIMFATLCFIAMLFAMSVYGVLFCEGVLVHLFSGCLMGFLWIQSGWIGHDAGHYMVVSDSRLNKFMGIFAANCLSGISIGWWKWNHNAHHIACNSLEYDPDLQYIPFLVVSSKFFGSLTSHFYEKRLTFDSLSRFFVSYQHWTFYPIMCAARLNMYVQSLIMLLTKRNVSYRAQELLGCLVFSIWYPLLVSCLPNWGERIMFVIASLSVTGMQQVQFSLNHFSSSVYVGKPKGNNWFEKQTDGTLDISCPPWMDWFHGGLQFQIEHHLFPKMPRCNLRKISPYVIELCKKHNLPYNYASFSKANEMTLRTLRNTALQARDITKPLPKNLVWEALHTHG

SEQ ID NO: 19 - DNA, 1563 bp, Ceratodon purpureus
  CDS (1)..(1563): Delta-6 desaturase
atggtgtcccagggcggcggtctctcgcagggttccattgaagaaaacattgacgttgagcacttggcaacgatgcccctcgtcagtgacttcctaaatgtcctgggaacgactttgggccagtggagtctttccactacattcgctttcaagaggctcacgactaagaaacacagttcggacatctcggtggaggcacaaaaagaatcggttgcgcgggggccagttgagaatatttctcaatcggttgcgcagcccatcaggcggaggtgggtgcaggataaaaagccggttacttacagcctgaaggatgtagcttcgcacgatatgccccaggactgctggattataatcaaagagaaggtgtatgatgtgagcaccttcgctgagcagcaccctggaggcacggttatcaacacctacttcggacgagacgccacagatgttttctctactttccacgcatccacctcatggaagattcttcagaatttctacatcgggaaccttgttagggaggagccgactttggagctgctgaaggagtacagagagttgagagcccttttcttgagagaacagcttttcaagagttccaaatcctactaccttttcaagactctcataaatgtttccattgttgccacaagcattgcgataatcagtctgtacaagtcttaccgggcggttctgttatcagccagtttgatgggcttgtttattcaacagtgcggatggttgtctcacgattttctacaccatcaggtatttgagacacgctggctcaatgacgttgttggctatgtggtcggcaacgttgttctgggattcagtgtctcgtggtggaagaccaagcacaacctgcatcatgctgctccgaatgaatgcgaccaaaagtacacaccgattgatgaggatattgatactctccccatcattgcttggagtaaagatctcttggccactgttgagagcaagaccatgttgcgagttcttcagtaccagcacctattctttttggttcttttgacgtttgcccgggcgagttggctattttggagcgcggccttcactctcaggcccgagttgacccttggcgagaagcttttggagaggggaacgatggctttgcactacatttggtttaatagtgttgcgttttatctgctccccggatggaaaccagttgtatggatggtggtcagcgagctcatgtctggtttcctgctgggatacgtatttgtactcagtcacaatggaatggaggtgtacaatacgtcaaaggacttcgtgaatgcccagattgcatcgactcgcgacatcaaagcaggggtgtttaatgattggttcaccggaggtctcaacagacagattgagcatcatctatttccaacgatgcccaggcacaaccttaataaaatttctcctcacgtggagactttgtgcaagaagcatggactggtctacgaagacgtgagcatggcttcgggcacttaccgggttttgaaaacacttaaggacgttgccgatgctgcttcacaccagcagcttgctgcgagttga

SEQ ID NO: 20 - protein, 520 aa, Ceratodon purpureus
MVSQGGGLSQGSIEENIDVEHLATMPLVSDFLNVLGTTLGQWSLSTTFAFKRLTTKKHSSDISVEAQKESVARGPVENISQSVAQPIRRRWVQDKKPVTYSLKDVASHDMPQDCWIIIKEKVYDVSTFAEQHPGGTVINTYFGRDATDVFSTFHASTSWKILQNFYIGNLVREEPTLELLKEYRELRALFLREQLFKSSKSYYLFKTLINVSIVATSIAIISLYKSYRAVLLSASLMGLFIQQCGWLSHDFLHHQVFETRWLNDVVGYVVGNVVLGFSVSWWKTKHNLHHAAPNECDQKYTPIDEDIDTLPIIAWSKDLLATVESKTMLRVLQYQHLFFLVLLTFARASWLFWSAAFTLRPELTLGEKLLERGTMALHYIWFNSVAFYLLPGWKPVVWMVVSELMSGFLLGYVFVLSHNGMEVYNTSKDFVNAQIASTRDIKAGVFNDWFTGGLNRQIEHHLFPTMPRHNLNKISPHVETLCKKHGLVYEDVSMASGTYRVLKTLKDVADAASHQQLAAS

SEQ ID NO: 21 - DNA, 1434 bp, Phaeodactylum tricornutum
  CDS (1)..(1434): Delta-6 desaturase
atgggcaaaggaggggacgctcgggcctcgaagggctcaacggcggctcgcaagatcagttggcaggaagtcaagacccacgcgtctccggaggacgcctggatcattcactccaataaggtctacgacgtgtccaactggcacgaacatcccggaggcgccgtcattttcacgcacgccggtgacgacatgacggacattttcgctgcctttcacgcacccggatcgcagtcgctcatgaagaagttctacattggcgaattgctcccggaaaccaccggcaaggagccgcagcaaatcgcctttgaaaagggctaccgcgatctgcgctccaaactcatcatgatgggcatgttcaagtccaacaagtggttctacgtctacaagtgcctcagcaacatggccatttgggccgccgcctgtgctctcgtcttttactcggaccgcttctgggtacacctggccagcgccgtcatgctgggaacattctttcagcagtcgggatggttggcacacgactttctgcaccaccaggtcttcaccaagcgcaagcacggggatctcggaggactcttttgggggaacctcatgcagggttactccgtacagtggtggaaaaacaagcacaacggacaccacgccgtccccaacctccactgctcctccgcagtcgcgcaagatggggacccggacatcgataccatgccccttctcgcctggtccgtccagcaagcccagtcttaccgggaactccaagccgacggaaaggattcgggtttggtcaagttcatgatccgtaaccaatcctacttttactttcccatcttgttgctcgcccgcctgtcgtggttgaacgagtccttcaagtgcgcctttgggcttggagctgcgtcggagaacgctgctctcgaactcaaggccaagggtcttcagtacccccttttggaaaaggctggcatcctgctgcactacgcttggatgcttacagtttcgtccggctttggacgcttctcgttcgcgtacaccgcattttactttctaaccgcgaccgcgtcctgtggattcttgctcgccattgtctttggcctcggccacaacggcatggccacctacaatgccgacgcccgtccggacttctggaagctccaagtcaccacgactcgcaacgtcacgggcggacacggtttcccccaagcctttgtcgactggttctgtggtggcctccagtaccaagtcgaccaccacttattccccagcctgccccgacacaatctggccaagacacacgcactggtcgaatcgttctgcaaggagtggggtgtccagtaccacgaagccgaccttgtggacgggaccatggaagtcttgcaccatttgggcagcgtggccggcgaattcgtcgtggattttgtacgcgatggacccgccatgtaa

SEQ ID NO: 22 - protein, 477 aa, Phaeodactylum tricornutum
MGKGGDARASKGSTAARKISWQEVKTHASPEDAWIIHSNKVYDVSNWHEHPGGAVIFTHAGDDMTDIFAAFHAPGSQSLMKKFYIGELLPETTGKEPQQIAFEKGYRDLRSKLIMMGMFKSNKWFYVYKCLSNMAIWAAACALVFYSDRFWVHLASAVMLGTFFQQSGWLAHDFLHHQVFTKRKHGDLGGLFWGNLMQGYSVQWWKNKHNGHHAVPNLHCSSAVAQDGDPDIDTMPLLAWSVQQAQSYRELQADGKDSGLVKFMIRNQSYFYFPILLLARLSWLNESFKCAFGLGAASENAALELKAKGLQYPLLEKAGILLHYAWMLTVSSGFGRFSFAYTAFYFLTATASCGFLLAIVFGLGHNGMATYNADARPDFWKLQVTTTRNVTGGHGFPQAFVDWFCGGLQYQVDHHLFPSLPRHNLAKTHALVESFCKEWGVQYHEADLVDGTMEVLHHLGSVAGEFVVDFVRDGPAM

SEQ ID NO: 23 - DNA, 1578 bp, Physcomitrella patens
  CDS (1)..(1578): Delta-6 desaturase
atggtattcgcgggcggtggacttcagcagggctctctcgaagaaaacatcgacgtcgagcacattgccagtatgtctctcttcagcgacttcttcagttatgtgtcttcaactgttggttcgtggagcgtacacagtatacaacctttgaagcgcctgacgagtaagaagcgtgtttcggaaagcgctgccgtgcaatgtatatcagctgaagttcagagaaattcgagtacccagggaactgcggaggcactcgcagaatcagtcgtgaagcccacgagacgaaggtcatctcagtggaagaagtcgacacaccccctatcagaagtagcagtacacaacaagccaagcgattgctggattgttgtaaaaaacaaggtgtatgatgtttccaattttgcggacgagcatcccggaggatcagttattagtacttattttggacgagacggcacagatgttttctctagttttcatgcagcttctacatggaaaattcttcaagacttttacattggtgacgtggagagggtggagccgactccagagctgctgaaagatttccgagaaatgagagctcttttcctgagggagcaacttttcaaaagttcgaaattgtactatgttatgaagctgctcacgaatgttgctatttttgctgcgagcattgcaataatatgttggagcaagactatttcagcggttttggcttcagcttgtatgatggctctgtgtttccaacagtgcggatggctatcccatgattttctccacaatcaggtgtttgagacacgctggcttaatgaagttgtcgggtatgtgatcggcaacgccgttctggggtttagtacagggtggtggaaggagaagcataaccttcatcatgctgctccaaatgaatgcgatcagacttaccaaccaattgatgaagatattgatactctccccctcattgcctggagcaaggacatactggccacagttgagaataagacattcttgcgaatcctccaataccagcatctgttcttcatgggtctgttatttttcgcccgtggtagttggctcttttggagctggagatatacctctacagcagtgctctcacctgtcgacaggttgttggagaagggaactgttctgtttcactacttttggttcgtcgggacagcgtgctatcttctccctggttggaagccattagtatggatggcggtgactgagctcatgtccggcatgctgctgggctttgtatttgtacttagccacaatgggatggaggtttataattcgtctaaagaattcgtgagtgcacagatcgtatccacacgggatatcaaaggaaacatattcaacgactggttcactggtggccttaacaggcaaatagagcatcatcttttcccaacaatgcccaggcataatttaaacaaaatagcacctagagtggaggtgttctgtaagaaacacggtctggtgtacgaagacgtatctattgctaccggcacttgcaaggttttgaaagcattgaaggaagtcgcggaggctgcggcagagcagcatgctaccaccagttaa

SEQ ID NO: 24 - protein, 525 aa, Physcomitrella patens
MVFAGGGLQQGSLEENIDVEHIASMSLFSDFFSYVSSTVGSWSVHSIQPLKRLTSKKRVSESAAVQCISAEVQRNSSTQGTAEALAESVVKPTRRRSSQWKKSTHPLSEVAVHNKPSDCWIVVKNKVYDVSNFADEHPGGSVISTYFGRDGTDVFSSFHAASTWKILQDFYIGDVERVEPTPELLKDFREMRALFLREQLFKSSKLYYVMKLLTNVAIFAASIAIICWSKTISAVLASACMMALCFQQCGWLSHDFLHNQVFETRWLNEVVGYVIGNAVLGFSTGWWKEKHNLHHAAPNECDQTYQPIDEDIDTLPLIAWSKDILATVENKTFLRILQYQHLFFMGLLFFARGSWLFWSWRYTSTAVLSPVDRLLEKGTVLFHYFWFVGTACYLLPGWKPLVWMAVTELMSGMLLGFVFVLSHNGMEVYNSSKEFVSAQIVSTRDIKGNIFNDWFTGGLNRQIEHHLFPTMPRHNLNKIAPRVEVFCKKHGLVYEDVSIATGTCKVLKALKEVAEAAAEQHATTS

SEQ ID NO: 25 - DNA, 1332 bp, Caenorhabditis elegans
  CDS (1)..(1332): Delta-6 desaturase
atggtcgtcgacaagaatgcctccgggcttcgaatgaaggtcgatggcaaatggctctaccttagcgaggaattggtgaagaaacatccaggaggagctgttattgaacaatatagaaattcggatgctactcatattttccacgctttccacgaaggatcttctcaggcttataagcaacttgaccttctgaaaaagcacggagagcacgatgaattccttgagaaacaattggaaaagagacttgacaaagttgatatcaatgtatcagcatatgatgtcagtgttgcacaagaaaagaaaatggttgaatcattcgaaaaactacgacagaagcttcatgatgatggattaatgaaagcaaatgaaacatatttcctgtttaaagcgatttcaacactttcaattatggcatttgcattttatcttcagtatcttggatggtatattacttctgcatgtttattagcacttgcatggcaacaattcggatggttaacacatgagttctgccatcaacagccaacaaagaacagacctttgaatgatactatttctttgttctttggtaatttcttacaaggattttcaagagattggtggaaggacaagcataacactcatcacgctgccacaaatgtaattgatcatgacggtgatatcgacttggcaccacttttcgcatttattccaggagatttgtgcaagtataaggccagctttgaaaaagcaattctcaagattgtaccatatcaacatctctatttcaccgcaatgcttccaatgctccgtttctcatggactggtcagtcagttcaatgggtattcaaagagaatcaaatggagtacaaggtctatcaaagaaatgcattctgggagcaagcaacaattgttggacattgggcttgggtattctatcaattgttcttattaccaacatggccacttcgggttgcttatttcattatttcacaaatgggaggaggccttttgattgctcacgtagtcactttcaaccataactctgttgataagtatccagccaattctcgaattttaaacaacttcgccgctcttcaaattttgaccacacgcaacatgactccatctccattcattgattggctttggggtggactcaattatcagatcgagcaccacttgttcccaacaatgccacgttgcaatctgaatgcttgcgtgaaatatgtgaaagaatggtgcaaagagaataatcttccttacctcgtcgatgactactttgacggatatgcaatgaatttgcaacaattgaaaaatatggctgagcacattcaagctaaagctgcctaa

SEQ ID NO: 26 - protein, 443 aa, Caenorhabditis elegans
MVVDKNASGLRMKVDGKWLYLSEELVKKHPGGAVIEQYRNSDATHIFHAFHEGSSQAYKQLDLLKKHGEHDEFLEKQLEKRLDKVDINVSAYDVSVAQEKKMVESFEKLRQKLHDDGLMKANETYFLFKAISTLSIMAFAFYLQYLGWYITSACLLALAWQQFGWLTHEFCHQQPTKNRPLNDTISLFFGNFLQGFSRDWWKDKHNTHHAATNVIDHDGDIDLAPLFAFIPGDLCKYKASFEKAILKIVPYQHLYFTAMLPMLRFSWTGQSVQWVFKENQMEYKVYQRNAFWEQATIVGHWAWVFYQLFLLPTWPLRVAYFIISQMGGGLLIAHVVTFNHNSVDKYPANSRILNNFAALQILTTRNMTPSPFIDWLWGGLNYQIEHHLFPTMPRCNLNACVKYVKEWCKENNLPYLVDDYFDGYAMNLQQLKNMAEHIQAKAA

SEQ ID NO: 27 - DNA, 873 bp, Physcomitrella patens
  CDS (1)..(873): Delta-6 elongase
atggaggtcgtggagagattctacggtgagttggatgggaaggtctcgcagggcgtgaatgcattgctgggtagttttggggtggagttgacggatacgcccactaccaaaggcttgcccctcgttgacagtcccacacccatcgtcctcggtgtttctgtatacttgactattgtcattggagggcttttgtggataaaggccagggatctgaaaccgcgcgcctcggagccatttttgctccaagctttggtgcttgtgcacaacctgttctgttttgcgctcagtctgtatatgtgcgtgggcatcgcttatcaggctattacctggcggtactctctctggggcaatgcatacaatcctaaacataaagagatggcgattctggtatacttgttctacatgtctaagtacgtggaattcatggataccgttatcatgatactgaagcgcagcaccaggcaaataagcttcctccacgtttatcatcattcttcaatttccctcatttggtgggctattgctcatcacgctcctggcggtgaagcatattggtctgcggctctgaactcaggagtgcatgttctcatgtatgcgtattacttcttggctgcctgccttcgaagtagcccaaagttaaaaaataagtaccttttttggggcaggtacttgacacaattccaaatgttccagtttatgctgaacttagtgcaggcttactacgacatgaaaacgaatgcgccatatccacaatggctgatcaagattttgttctactacatgatctcgttgctgtttcttttcggcaatttttacgtacaaaaatacatcaaaccctctgacggaaagcaaaagggagctaaaactgagtga

SEQ ID NO: 28 - protein, 290 aa, Physcomitrella patens
MEVVERFYGELDGKVSQGVNALLGSFGVELTDTPTTKGLPLVDSPTPIVLGVSVYLTIVIGGLLWIKARDLKPRASEPFLLQALVLVHNLFCFALSLYMCVGIAYQAITWRYSLWGNAYNPKHKEMAILVYLFYMSKYVEFMDTVIMILKRSTRQISFLHVYHHSSISLIWWAIAHHAPGGEAYWSAALNSGVHVLMYAYYFLAACLRSSPKLKNKYLFWGRYLTQFQMFQFMLNLVQAYYDMKTNAPYPQWLIKILFYYMISLLFLFGNFYVQKYIKPSDGKQKGAKTE

SEQ ID NO: 29 - DNA, 1049 bp, Thraustochytrium
  CDS (43)..(858): Delta-6 elongase
gaattcggcacgagagcgcgcggagcggagacctcggccgcgatgatggagccgctcgacaggtacagggcgctggcggagctcgccgcgaggtacgccagctcggcggccttcaagtggcaagtcacgtacgacgccaaggacagcttcgtcgggcccctgggaatccgggagccgctcgggctcctggtgggctccgtggtcctctacctgagcctgctggccgtggtctacgcgctgcggaactaccttggcggcctcatggcgctccgcagcgtgcataacctcgggctctgcctcttctcgggcgccgtgtggatctacacgagctacctcatgatccaggatgggcactttcgcagcctcgaggcggcaacgtgcgagccgctcaagcatccgcacttccagctcatcagcttgctctttgcgctgtccaagatctgggagtggttcgacacggtgctcctcatcgtcaagggcaacaagctccgcttcctgcacgtcttgcaccacgccacgaccttttggctctacgccatcgaccacatctttctctcgtccatcaagtacggcgtcgcggtcaatgctttcatccacaccgtcatgtacgcgcactacttccgcccattcccgaagggcttgcgcccgcttattacgcagttgcagatcgtccagttcattttcagcatcggcatccataccgccatttactggcactacgactgcgagccgctcgtgcatacccacttttgggaatacgtcacgccctaccttttcgtcgtgcccttcctcatcctctttttcaatttttacctgcagcagtacgtcctcgcgcccgcaaaaaccaagaaggcatagccacgtaacagtagaccagcagcgccgaggacgcgtgccgcgttatcgcgaagcacgaaataaagaagatcatttgattcaacgaggctacttgcggccacgagaaaaaaaaaaaaaaaaaaaaaaaaaaaaaaaaaaaaaaaaaaaaaaaaaaaaaaaaaaaaaaaaaaaaaaaaaaaaaaaaaaaaaac

SEQ ID NO: 30 - protein, 271 aa, Thraustochytrium
MMEPLDRYRALAELAARYASSAAFKWQVTYDAKDSFVGPLGIREPLGLLVGSVVLYLSLLAVVYALRNYLGGLMALRSVHNLGLCLFSGAVWIYTSYLMIQDGHFRSLEAATCEPLKHPHFQLISLLFALSKIWEWFDTVLLIVKGNKLRFLHVLHHATTFWLYAIDHIFLSSIKYGVAVNAFIHTVMYAHYFRPFPKGLRPLITQLQIVQFIFSIGIHTAIYWHYDCEPLVHTHFWEYVTPYLFVVPFLILFFNFYLQQYVLAPAKTKKA

SEQ ID NO: 31 - DNA, 837 bp, Phytophthora infestans
  CDS (1)..(837): Delta-6 elongase
atgtcgactgagctactgcagagctactacgcgtgggccaacgccacggaggccaagctgctggactgggtcgaccctgagggcggctggaaggtgcatcctatggcagactaccccctagccaacttctccagcgtctacgccatctgcgtcggatacttgctcttcgtaatcttcggcacggccctgatgaaaatgggagtccccgccatcaagaccagtccattacagtttgtgtacaaccccatccaagtcattgcctgctcttatatgtgcgtggaggccgccatccaggcctaccgcaacggctacaccgccgccccgtgcaacgcctttaagtccgacgaccccgtcatgggcaacgttctgtacctcttctatctctccaagatgctcgacctgtgcgacacagtcttcattatcctaggaaagaagtggaaacagctttccatcttgcacgtgtaccaccaccttaccgtgcttttcgtctactatgtgacgttccgcgccgctcaggacggggactcatatgctaccatcgtgctcaacggcttcgtgcacaccatcatgtacacttactacttcgtcagcgcccacacgcgcaacatttggtggaagaagtacctcacgcgcattcagcttatccagttcgtgaccatgaacgtgcagggctacctgacctactctcgacagtgcccaggcatgcctcctaaggtgccgctcatgtaccttgtgtacgtgcagtcactcttctggctcttcatgaatttctacattcgcgcgtacgtgttcggccccaagaaaccggccgtggaggaatcgaagaagaagttgtaa

SEQ ID NO: 32 - protein, 278 aa, Phytophthora infestans
MSTELLQSYYAWANATEAKLLDWVDPEGGWKVHPMADYPLANFSSVYAICVGYLLFVIFGTALMKMGVPAIKTSPLQFVYNPIQVIACSYMCVEAAIQAYRNGYTAAPCNAFKSDDPVMGNVLYLFYLSKMLDLCDTVFIILGKKWKQLSILHVYHHLTVLFVYYVTFRAAQDGDSYATIVLNGFVHTIMYTYYFVSAHTRNIWWKKYLTRIQLIQFVTMNVQGYLTYSRQCPGMPPKVPLMYLVYVQSLFWLFMNFYIRAYVFGPKKPAVEESKKKL

SEQ ID NO: 33 - DNA, 954 bp, Mortierella alpina
  CDS (1)..(954): Delta-6 elongase
atggccgccgcaatcttggacaaggtcaacttcggcattgatcagcccttcggaatcaagctcgacacctactttgctcaggcctatgaactcgtcaccggaaagtccatcgactccttcgtcttccaggagggcgtcacgcctctctcgacccagagagaggtcgccatgtggactatcacttacttcgtcgtcatctttggtggtcgccagatcatgaagagccaggacgccttcaagctcaagcccctcttcatcctccacaacttcctcctgacgatcgcgtccggatcgctgttgctcctgttcatcgagaacctggtccccatcctcgccagaaacggacttttctacgccatctgcgacgacggtgcctggacccagcgcctcgagctcctctactacctcaactacctggtcaagtactgggagttggccgacaccgtctttttggtcctcaagaagaagcctcttgagttcctgcactacttccaccactcgatgaccatggttctctgctttgtccagcttggaggatacacttcagtgtcctgggtccctattaccctcaacttgactgtccacgtcttcatgtactactactacatgcgctccgctgccggtgttcgcatctggtggaagcagtacttgaccactctccagatcgtccagttcgttcttgacctcggattcatctacttctgcgcctacacctacttcgccttcacctacttcccctgggctcccaacgtcggcaagtgcgccggtaccgagggtgctgctctctttggctgcggactcctctccagctatctcttgctctttatcaacttctaccgcattacctacaatgccaaggccaaggcagccaaggagcgtggaagcaactttacccccaagactgtcaagtccggcggatcgcccaagaagccctccaagagcaagcacatctaa

SEQ ID NO: 34 - protein, 317 aa, Mortierella alpina
MAAAILDKVNFGIDQPFGIKLDTYFAQAYELVTGKSIDSFVFQEGVTPLSTQREVAMWTITYFVVIFGGRQIMKSQDAFKLKPLFILHNFLLTIASGSLLLLFIENLVPILARNGLFYAICDDGAWTQRLELLYYLNYLVKYWELADTVFLVLKKKPLEFLHYFHHSMTMVLCFVQLGGYTSVSWVPITLNLTVHVFMYYYYMRSAAGVRIWWKQYLTTLQIVQFVLDLGFIYFCAYTYFAFTYFPWAPNVGKCAGTEGAALFGCGLLSSYLLLFINFYRITYNAKAKAAKERGSNFTPKTVKSGGSPKKPSKSKHI

SEQ ID NO: 35 - DNA, 957 bp, Mortierella alpina
  CDS (1)..(957): Delta-6 elongase
atggagtcgattgcgccattcctcccatcaaagatgccgcaagatctgtttatggaccttgccaccgctatcggtgtccgggccgcgccctatgtcgatcctctcgaggccgcgctggtggcccaggccgagaagtacatccccacgattgtccatcacacgcgtgggttcctggtcgcggtggagtcgcctttggcccgtgagctgccgttgatgaacccgttccacgtgctgttgatcgtgctcgcttatttggtcacggtctttgtgggcatgcagatcatgaagaactttgagcggttcgaggtcaagacgttttcgctcctgcacaacttttgtctggtctcgatcagcgcctacatgtgcggtgggatcctgtacgaggcttatcaggccaactatggactgtttgagaacgctgctgatcataccttcaagggtcttcctatggccaagatgatctggctcttctacttctccaagatcatggagtttgtcgacaccatgatcatggtcctcaagaagaacaaccgccagatctccttcttgcacgtttaccaccacagctccatcttcaccatctggtggttggtcacctttgttgcacccaacggtgaagcctacttctctgctgcgttgaactcgttcatccatgtgatcatgtacggctactacttcttgtcggccttgggcttcaagcaggtgtcgttcatcaagttctacatcacgcgctcgcagatgacacagttctgcatgatgtcggtccagtcttcctgggacatgtacgccatgaaggtccttggccgccccggataccccttcttcatcacggctctgctttggttctacatgtggaccatgctcggtctcttctacaacttttacagaaagaacgccaagttggccaagcaggccaaggccgacgctgccaaggagaaggcaaggaagttgcagtaa

SEQ ID NO: 36 - protein, 318 aa, Mortierella alpina
MESIAPFLPSKMPQDLFMDLATAIGVRAAPYVDPLEAALVAQAEKYIPTIVHHTRGFLVAVESPLARELPLMNPFHVLLIVLAYLVTVFVGMQIMKNFERFEVKTFSLLHNFCLVSISAYMCGGILYEAYQANYGLFENAADHTFKGLPMAKMIWLFYFSKIMEFVDTMIMVLKKNNRQISFLHVYHHSSIFTIWWLVTFVAPNGEAYFSAALNSFIHVIMYGYYFLSALGFKQVSFIKFYITRSQMTQFCMMSVQSSWDMYAMKVLGRPGYPFFITALLWFYMWTMLGLFYNFYRKNAKLAKQAKADAAKEKARKLQ

SEQ ID NO: 37 - DNA, 867 bp, Caenorhabditis elegans
  CDS (1)..(867): Delta-6 elongase
atggctcagcatccgctcgttcaacggcttctcgatgtcaaattcgacacgaaacgatttgtggctattgctactcatgggccaaagaatttccctgacgcagaaggtcgcaagttctttgctgatcactttgatgttactattcaggcttcaatcctgtacatggtcgttgtgttcggaacaaaatggttcatgcgtaatcgtcaaccattccaattgactattccactcaacatctggaatttcatcctcgccgcattttccatcgcaggagctgtcaaaatgaccccagagttctttggaaccattgccaacaaaggaattgtcgcatcctactgcaaagtgtttgatttcacgaaaggagagaatggatactgggtgtggctcttcatggcttccaaacttttcgaacttgttgacaccatcttcttggttctccgtaaacgtccactcatgttccttcactggtatcaccatattctcaccatgatctacgcctggtactctcatccattgaccccaggattcaacagatacggaatttatcttaactttgtcgtccacgccttcatgtactcttactacttccttcgctcgatgaagattcgcgtgccaggattcatcgcccaagctatcacatctcttcaaatcgttcaattcatcatctcttgcgccgttcttgctcatcttggttatctcatgcacttcaccaatgccaactgtgatttcgagccatcagtattcaagctcgcagttttcatggacacaacatacttggctcttttcgtcaacttcttcctccaatcatatgttctccgcggaggaaaagacaagtacaaggcagtgccaaagaagaagaacaactaa

SEQ ID NO: 38 - protein, 288 aa, Caenorhabditis elegans
MAQHPLVQRLLDVKFDTKRFVAIATHGPKNFPDAEGRKFFADHFDVTIQASILYMVVVFGTKWFMRNRQPFQLTIPLNIWNFILAAFSIAGAVKMTPEFFGTIANKGIVASYCKVFDFTKGENGYWVWLFMASKLFELVDTIFLVLRKRPLMFLHWYHHILTMIYAWYSHPLTPGFNRYGIYLNFVVHAFMYSYYFLRSMKIRVPGFIAQAITSLQIVQFIISCAVLAHLGYLMHFTNANCDFEPSVFKLAVFMDTTYLALFVNFFLQSYVLRGGKDKYKAVPKKKNN

SEQ ID NO: 39 - DNA, 1626 bp, Euglena gracilis
  CDS (1)..(1626): Delta-4 desaturase
atgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccacccgtccagctggacccccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcatcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgatggcaaccacggcgcgttcagccgcaacacactggtgaaccgcctggcggggtggggcatggacttgatcggcgcgtcgtccacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgctcaccttgtgtcgggggagtacctcgcgatctgcttcatcatcaaccacatcagcgagtcttgtgagtttatgaatacaagctttcaaaccgccgcccggaggacagagatgcttcaggcagcacatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccaccatcgcccctgttgtgaaggaggtgtgcgaggagtacgggttgccgtacaagaattacgtcacgttctgggatgcagtctgtggcatggttcagcacctccggttgatgggtgctccaccggtgccaacgaacggggacaaaaagtcataa

SEQ ID NO: 40 - protein, 541 aa, Euglena gracilis
MLVLFGNFYVKQYSQKNGKPENGATPENGAKPQPCENGTVEKRENDTANVRPTRPAGPPPATYYDSLAVSGQGKERLFTTDEVRRHILPTDGWLTCHEGVYDVTDFLAKHPGGGVITLGLGRDCTILIESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRNTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPTIAPVVKEVCEEYGLPYKNYVTFWDAVCGMVQHLRLMGAPPVPTNGDKKS

SEQ ID NO: 41 - DNA, 1548 bp, Thraustochytrium
  CDS (1)..(1548): Delta-4 desaturase
atgacggtcgggtttgacgaaacggtgactatggacacggtccgcaaccacaacatgccggacgacgcctggtgcgcgatccacggcaccgtgtacgacatcaccaagttcagcaaggtgcaccccggcggggacatcatcatgctggccgctggcaaggaggccaccatcctgttcgagacctaccacatcaagggcgtcccggacgcggtgctgcgcaagtacaaggtcggcaagctcccccagggcaagaagggcgaaacgagccacatgcccaccgggctcgactcggcctcctactactcgtgggacagcgagttttacagggtgctccgcgagcgcgtcgccaagaagctggccgagcccggcctcatgcagcgcgcgcgcatggagctctgggccaaggcgatcttcctcctggcaggtttctggggctccctttacgccatgtgcgtgctagacccgcacggcggtgccatggtagccgccgttacgctcggcgtgttcgctgcctttgtcggaacttgcatccagcacgacggcagccacggcgccttctccaagtcgcgattcatgaacaaggcggcgggctggaccctcgacatgatcggcgcgagtgcgatgacctgggagatgcagcacgttcttggccaccacccgtacaccaacctcatcgagatggagaacggtttggccaaggtcaagggcgccgacgtcgacccgaagaaggtcgaccaggagagcgacccggacgtcttcagtacgtacccgatgcttcgcctgcacccgtggcaccgccagcggttttaccacaagttccagcacctgtacgccccgtttatctttgggtctatgacgattaacaaggtgatttcccaggatgtcggggttgtgctgcgcaagcgcctgttccagatcgacgccaactgccggtatggcagcccctggtacgtggcccgcttctggatcatgaagctcctcaccacgctctacatggtggcgcttcccatgtacatgcaggggcctgctcagggcttgaagcttttcttcatggcccacttcacctgcggagaggtcctcgccaccatgtttattgtcaaccacatcatcgagggcgtcagctacgcttccaaggacgcggtcaagggcgtcatggctccgccgcgcactgtgcacggtgtcaccccgatgcaggtgacgcaaaaggcgctcagtgcggccgagtcggccaagtcggacgccgacaagacgaccatgatccccctcaacgactgggccgctgtgcagtgccagacctctgtgaactgggctgtcgggtcgtggttttggaaccacttttcgggcggcctcaaccaccagattgagcaccactgcttcccccaaaacccccacacggtcaacgtctacatctcgggcatcgtcaaggagacctgcgaagaatacggcgtgccgtaccaggctgagatcagcctcttctctgcctatttcaagatgctgtcgcacctccgcacgctcggcaacgaggacctcacggcctggtccacgtga

SEQ ID NO: 42 - protein, 515 aa, Thraustochytrium
MTVGFDETVTMDTVRNHNMPDDAWCAIHGTVYDITKFSKVHPGGDIIMLAAGKEATILFETYHIKGVPDAVLRKYKVGKLPQGKKGETSHMPTGLDSASYYSWDSEFYRVLRERVAKKLAEPGLMQRARMELWAKAIFLLAGFWGSLYAMCVLDPHGGAMVAAVTLGVFAAFVGTCIQHDGSHGAFSKSRFMNKAAGWTLDMIGASAMTWEMQHVLGHHPYTNLIEMENGLAKVKGADVDPKKVDQESDPDVFSTYPMLRLHPWHRQRFYHKFQHLYAPFIFGSMTINKVISQDVGVVLRKRLFQIDANCRYGSPWYVARFWIMKLLTTLYMVALPMYMQGPAQGLKLFFMAHFTCGEVLATMFIVNHIIEGVSYASKDAVKGVMAPPRTVHGVTPMQVTQKALSAAESAKSDADKTTMIPLNDWAAVQCQTSVNWAVGSWFWNHFSGGLNHQIEHHCFPQNPHTVNVYISGIVKETCEEYGVPYQAEISLFSAYFKMLSHLRTLGNEDLTAWST

SEQ ID NO: 43 - DNA, 960 bp, Thalassiosira pseudonana
  CDS (1)..(960): Delta-5 elongase
atggtgttgtacaatgtggcgcaagtgctgctcaatgggtggacggtgtatgcgattgtggatgcggtgatgaatagagaccatccgtttattggaagtagaagtttggttggggcggcgttgcatagtgggagctcgtatgcggtgtgggttcattattgtgataagtatttggagttctttgatacgtattttatggtgttgagggggaaaatggaccagatggtacttggtgaagttggtggcagtgtgtggtgtggcgttggatatatggatatggagaagatgatactactcagctttggagtgcatcggtctgctcagggaacggggaaggctttcaccaacaacgttaccaatccacatctcacgcttccacctcattctacaaaaacaaaaaaacaggtctccttcctccacatctaccaccacacgaccatagcgtgggcatggtggatcgccctccgcttctcccccggtggagacatttacttcggggcactcctcaactccatcatccacgtcctcatgtattcctactacgcccttgccctactcaaggtcagttgtccatggaaacgatacctgactcaagctcaattattgcaattcacaagtgtggtggtttatacggggtgtacgggttatactcattactatcatacgaagcatggagcggatgagacacagcctagtttaggaacgtattatttctgttgtggagtgcaggtgtttgagatggttagtttgtttgtactcttttccatcttttataaacgatcctattcgaagaagaacaagtcaggaggaaaggatagcaagaagaatgatgatgggaataatgaggatcaatgtcacaaggctatgaaggatatatcggagggtgcgaaggaggttgtggggcatgcagcgaaggatgctggaaagttggtggctacgagagtaaggtgtaaggtgtaa

SEQ ID NO: 44 - protein, 319 aa, Thalassiosira pseudonana
MVLYNVAQVLLNGWTVYAIVDAVMNRDHPFIGSRSLVGAALHSGSSYAVWVHYCDKYLEFFDTYFMVLRGKMDQMVLGEVGGSVWCGVGYMDMEKMILLSFGVHRSAQGTGKAFTNNVTNPHLTLPPHSTKTKKQVSFLHIYHHTTIAWAWWIALRFSPGGDIYFGALLNSIIHVLMYSYYALALLKVSCPWKRYLTQAQLLQFTSVVVYTGCTGYTHYYHTKHGADETQPSLGTYYFCCGVQVFEMVSLFVLFSIFYKRSYSKKNKSGGKDSKKNDDGNNEDQCHKAMKDISEGAKEVVGHAAKDAGKLVATRVRCKV

SEQ ID NO: 45 - DNA, 819 bp, Thalassiosira pseudonana
  CDS (1)..(819): Delta-5 elongase
atggacgcctacaacgctgcaatggataagatcggtgccgccatcatcgattggtctgatcccgatggaaagttccgtgccgatagagaggactggtggctctgcgacttccgtagcgccatcaccatcgccctcatctacatcgccttcgtcatcctcggttccgccgtcatgcaatccctccccgcaatggatccctaccccatcaaattcctctacaacgtctcccaaatcttcctttgtgcctacatgactgtcgaggcgggatttttggcctaccgcaatggatataccgtcatgccttgcaatcatttcaatgtgaatgatcctcccgtggcgaatcttctttggttgttttatatttccaaggtgtgggacttttgggataccattttcattgtgttggggaagaagtggcgtcaattatctttcttgcatgtataccatcacaccaccatctttctattctattggctgaatgccaatgtcttgtacgatggtgacatcttccttaccatcttgctcaatggattcatccacacggtgatgtacacgtattacttcatctgtatgcataccaaagattccaagacgggcaagagtcttcctatatggtggaagtcgagtttgacggcgtttcagttgttgcaattcactatcatgatgagtcaggctacctaccttgtcttccacgggtgtgataaggtgtcgcttcgtatcacgattgtgtactttgtgtcccttttgagtttgttcttcctttttgctcagttctttgtgcaatcatacatggcacccaaaaagaagaagagtgcttag

SEQ ID NO: 46 - protein, 272 aa, Thalassiosira pseudonana
MDAYNAAMDKIGAAIIDWSDPDGKFRADREDWWLCDFRSAITIALIYIAFVILGSAVMQSLPAMDPYPIKFLYNVSQIFLCAYMTVEAGFLAYRNGYTVMPCNHFNVNDPPVANLLWLFYISKVWDFWDTIFIVLGKKWRQLSFLHVYHHTTIFLFYWLNANVLYDGDIFLTILLNGFIHTVMYTYYFICMHTKDSKTGKSLPIWWKSSLTAFQLLQFTIMMSQATYLVFHGCDKVSLRITIVYFVSLLSLFFLFAQFFVQSYMAPKKKKSA

SEQ ID NO: 47 - DNA, 936 bp, Crypthecodinium cohnii
  CDS (1)..(936): Delta-5 elongase
atgtctgccttcatgactctcccacaggctctctccgatgtgacctcggccttggtcacgctgggaaaggatgtctccagcccttcagcttttcaagctgtcactggcttctgcagggagcagtgggggattccgacagtattctgcctgggctacttggccatggtctacgcggccagaagacccctcccgcagcacggctacatggttgcggtggaccgttgcttcgctgcttggaacttggctctctctgtcttcagcacttggggcttctaccacatggctgtcgggctctacaacatgacagagacgaggggcttgcaattcaccatctgcggttcgactggggagctcgtgcagaaccttcagactggcccaaccgctctggcgctctgcctcttctgcttcagcaagatccccgagttgatggacacggtgtttctcatcctgaaggccaagaaggtccgcttcttgcagtggtaccaccatgccacagtcatgctcttctgttggctcgccctcgcgacggagtacactcctggcttgtggtttgcggcgacgaactacttcgtgcactccatcatgtacatgtacttcttcctcatgaccttcaagtcggccgcgaaggtggtgaagcccatcgcccctctcatcacagttatccagattgctcagatggtctggggcctcatcgtcaacggcatcgccatcaccaccttcttcacgactggtgcctgccagatccagtctgtgactgtgtattcggccatcatcatgtacgcttcgtacttctacctgttctcccagctcttcttcgaggcccatggtgccgctggcaagaacaagaagaagttgacccgcgagctctctcgaaaaatctcggaggctctcctgaacaccggtgacgaggtttccaagcacctgaaggtgaattga

SEQ ID NO: 48 - protein, 311 aa, Crypthecodinium cohnii
MSAFMTLPQALSDVTSALVTLGKDVSSPSAFQAVTGFCREQWGIPTVFCLGYLAMVYAARRPLPQHGYMVAVDRCFAAWNLALSVFSTWGFYHMAVGLYNMTETRGLQFTICGSTGELVQNLQTGPTALALCLFCFSKIPELMDTVFLILKAKKVRFLQWYHHATVMLFCWLALATEYTPGLWFAATNYFVHSIMYMYFFLMTFKSAAKVVKPIAPLITVIQIAQMVWGLIVNGIAITTFFTTGACQIQSVTVYSAIIMYASYFYLFSQLFFEAHGAAGKNKKKLTRELSRKISEALLNTGDEVSKHLKVN

SEQ ID NO: 49 - DNA, 927 bp, Crypthecodinium cohnii
  CDS (1)..(927): Delta-5 elongase
atggcttcctaccaacaagcattctccgaattggctagagctttgtccactttgaaccacgacttctccagcgtcgagccattcaaagtcgtgacgcagttctgcagggaccagtgggcgatcccgacagtcttttgcatcggttacttggcaatggtctacgccacgcgaagacctatcgcgaagcacccctacatgtctctcgtggatcgctgctttgcggcctggaacttgggcctctcgctcttcagttgctggggcttctaccacatggcagtgggactctcccacaccacttggaatttcgggctccagttcaccatctgcggcagcaccacggagcttgtgaatggcttccagaagggcccggcggccctcgccctcatcctgttctgcttctccaagatcccggagttgggcgacaccgtcttcttgatcttgaagggaaagaaggtccgcttcttgcagtggtaccaccacacgaccgtgatgctcttctgttggatggccttggcgactgagtacactcctggattgtggttcgcggccacgaactacttcgtgcactccatcatgtacatgtacttcttcctcatgaccttcaagacggccgccggcatcatcaagcccatcgcgcctctcatcaccatcatccagatctcccagatggtctggggcttggtcgtgaacgccatcgccgtcggcaccttcttcaccacaggcaactgccagatccaggcagtgacagtctactccgccatcgtgatgtacgcctcctacttctacctcttcggccagctcttcttcgaggcccagggttcggctggaaaggacaagaagaagttggcccgagagctgagccgaaaggtctcgcgggctctcacagcaacgggcgaagaggtgtcgaagcacatgaaggtgaattga

SEQ ID NO: 50 - protein, 308 aa, Crypthecodinium cohnii
MASYQQAFSELARALSTLNHDFSSVEPFKVVTQFCRDQWAIPTVFCIGYLAMVYATRRPIAKHPYMSLVDRCFAAWNLGLSLFSCWGFYHMAVGLSHTTWNFGLQFTICGSTTELVNGFQKGPAALALILFCFSKIPELGDTVFLILKGKKVRFLQWYHHTTVMLFCWMALATEYTPGLWFAATNYFVHSIMYMYFFLMTFKTAAGIIKPIAPLITIIQISQMVWGLVVNAIAVGTFFTTGNCQIQAVTVYSAIVMYASYFYLFGQLFFEAQGSAGKDKKKLARELSRKVSRALTATGEEVSKHMKVN

SEQ ID NO: 51 - DNA, 795 bp, Oncorhynchus mykiss
  CDS (1)..(795): Delta-5 elongase
atggcttcaacatggcaaagcgttcagtccatgcgccagtggattttagagaatggagataaaaggacagacccatggctactggtctactcccctatgccagtggccattatattcctcctctatcttggtgtggtctgggctgggcccaagctgatgaaacgcagggaaccagttgatctcaaggctgtactcattgtctacaacttcgccatggtctgcctgtctgtctacatgttccatgagttcttggtcacgtccttgctgtctaactacagttacctgtgtcaacctgtggattacagcactagtccactggcgatgaggatggccaaagtatgctggtggtttttcttctccaaggtcatagaattggctgacacggtgttcttcatcctgaggaagaagaacagtcagctgactttcctgcatgtctatcaccatggcaccatgatcttcaactggtgggcaggggtcaagtatctggctggaggccaatcgttcttcatcggcctgctcaatacctttgtgcacatcgtgatgtactcttactacggactggctgccctggggcctcacacgcagaagtacttatggtggaagcgctatctgacctcactgcagctgctccagtttgtcctgttgaccactcacactggctacaacctcttcactgagtgtgacttcccggactccatgaacgctgtggtgtttgcctactgtgtcagtctcattgctctcttcagcaacttctactatcagagctacctcaacaggaagagcaagaagacataa

SEQ ID NO: 52 - protein, 264 aa, Oncorhynchus mykiss
MASTWQSVQSMRQWILENGDKRTDPWLLVYSPMPVAIIFLLYLGVVWAGPKLMKRREPVDLKAVLIVYNFAMVCLSVYMFHEFLVTSLLSNYSYLCQPVDYSTSPLAMRMAKVCWWFFFSKVIELADTVFFILRKKNSQLTFLHVYHHGTMIFNWWAGVKYLAGGQSFFIGLLNTFVHIVMYSYYGLAALGPHTQKYLWWKRYLTSLQLLQFVLLTTHTGYNLFTECDFPDSMNAVVFAYCVSLIALFSNFYYQSYLNRKSKKT

SEQ ID NO: 53 - DNA, 885 bp, Oncorhynchus mykiss
  CDS (1)..(885): Delta-5 elongase
atggagacttttaattataaactaaacatgtacatagactcatggatgggtcccagagatgagcgggtacagggatggctgcttctggacaactaccctccaacctttgcactaacagtcatgtacctgctgatcgtatggatggggcccaagtacatgagacacagacagccggtgtcttgccggggtctcctcttggtctacaatctgggcctcacgatcttgtccttctatatgttctatgagatggtgtctgctgtgtggcacggggattataacttcttttgccaagacacacacagtgcaggagaaaccgataccaagatcataaatgtgctgtggtggtactacttctccaagctcatagagtttatggataccttcttcttcatcctgcggaagaacaaccatcaaatcacgtttctgcacatctaccaccatgctagcatgctcaacatctggtggttcgtcatgaactgggtgccctgtggtcactcctactttggtgcctccctgaacagcttcatccatgtcctgatgtactcttactatgggctctctgctgtcccggccttgcggccctatctatggtggaagaaatacatcacacaagtacagctgattcagttctttttgaccatgtcccagacgatatgtgcagtcatttggccatgtgatttccccagagggtggctgtatttccagatattctatgtcatcacacttattgcccttttctcaaacttctacattcagacttacaagaaacaccttgtttcacaaaagaaggagtatcatcagaatggctctgttgcttcattgaatggccatgtgaatggggtgacacccacggaaaccattacacacaggaaagtgaggggggac

SEQ ID NO: 54 - protein, 295 aa, Oncorhynchus mykiss
METFNYKLNMYIDSWMGPRDERVQGWLLLDNYPPTFALTVMYLLIVWMGPKYMRHRQPVSCRGLLLVYNLGLTILSFYMFYEMVSAVWHGDYNFFCQDTHSAGETDTKIINVLWWYYFSKLIEFMDTFFFILRKNNHQITFLHIYHHASMLNIWWFVMNWVPCGHSYFGASLNSFIHVLMYSYYGLSAVPALRPYLWWKKYITQVQLIQFFLTMSQTICAVIWPCDFPRGWLYFQIFYVITLIALFSNFYIQTYKKHLVSQKKEYHQNGSVASLNGHVNGVTPTETITHRKVRGD

SEQ ID NO: 55 - DNA, 6753 bp, Oncorhynchus mykiss
  CDS (513)..(1397): Delta-5 elongase
acggattagaagccgccgagcgggtgacagccctccgaaggaagactctcctccgtgcgtcctcgtcctcaccggtcgcgttcctgaaacgcagatgtgcctcgcgccgcactgctccgaacaataaagattctacaatactagcttttatggttatgaagaggaaaaattggcagtaacctggccccacaaaccttcaaatgaacgaatcaaattaacaaccataggatgataatgcgattagttttttagccttatttctggggtaattaatcagcgaagcgatgatttttgatctattaacagatatataaatgcaaaaactgcattaaccactttaactaatactttcaacattttcggtttgtattacttcttattcaaatgtaataaaagtatcaacaaaaaattgttaatatacctctatactttaacgtcaaggagaaaaaaccccggatcggactactagcagctgtaatacgactcactatagggaatattaagcttacataatggagacttttaattataaactaaacatgtacatagactcatggatgggtcccagagatgagcgggtacagggatggctgcttctggacaactaccctccaacctttgcactaacagtcatgtacctgctgatcgtatggatggggcccaagtacatgagacacagacagccggtgtcttgccggggtctcctcttggtctacaatctgggcctcacgatcttgtccttctatatgttctatgagatggtgtctgctgtgtggcacggggattataacttcttttgccaagacacacacagtgcaggagaaaccgataccaagatcataaatgtgctgtggtggtactacttctccaagctcatagagtttatggataccttcttcttcatcctgcggaagaacaaccatcaaatcacgtttctgcacatctaccaccatgctagcatgctcaacatctggtggttcgtcatgaactgggtgccctgtggtcactcctactttggtgcctccctgaacagcttcatccatgtcctgatgtactcttactatgggctctctgctgtcccggccttgcggccctatctatggtggaagaaatacatcacacaagtacagctgattcagttctttttgaccatgtcccagacgatatgtgcagtcatttggccatgtgatttccccagagggtggctgtatttccagatattctatgtcatcacacttattgcccttttctcaaacttctacattcagacttacaagaaacaccttgtttcacaaaagaaggagtatcatcagaatggctctgttgcttcattgaatggccatgtgaatggggtgacacccacggaaaccattacacacaggaaagtgaggggggactgaaggatccactagtaacggccgccagtgtgctggaattctgcagatatccagcacagtggcggccgctcgagtctagagggcccttcgaaggtaagcctatccctaaccctctcctcggtctcgattctacgcgtaccggtcatcatcaccatcaccattgagtttaaacccgctgatcctagagggccgcatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctgcggccctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagcgcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaaattcggtcgaaaaaagaaaaggagagggccaagagggagggcattggtgactattgagcacgtgagtatacgtgattaagcacacaaaggcagcttggagtatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcacggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgagagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaataggttattactgagtagtatttatttaagtattgtttgtgcacttgccctagcttatcgatgataagctgtcaaagatgagaattaattccacggactatagactatactagatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgacgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatgggaagctccaccccggttgataatcagaaaagccccaaaaacaggaagattgtataagcaaatatttaaattgtaaacgttaatattttgttaaaattcgcgttaaatttttgttaaatcagctcattttttaacgaatagcccgaaatcggcaaaatcccttataaatcaaaagaatagaccgagatagggttgagtgttgttccagtttccaacaagagtccactattaaagaacgtggactccaacgtcaaagggcgaaaaagggtctatcagggcgatggcccactacgtgaaccatcaccctaatcaagttttttggggtcgaggtgccgtaaagcagtaaatcggaagggtaaacggatgcccccatttagagcttgacggggaaagccggcgaacgtggcgagaaaggaagggaagaaagcgaaaggagcgggggctagggcggtgggaagtgtaggggtcacgctgggcgtaaccaccacacccgccgcgcttaatggggcgctacagggcgcgtggggatgatccactagt

SEQ ID NO: 56 - protein, 295 aa, Oncorhynchus mykiss; identical to SEQ ID NO: 54

SEQ ID NO: 57 - DNA, 6645 bp, Oncorhynchus mykiss
  CDS (513)..(1304): Delta-5 elongase
acggattagaagccgccgagcgggtgacagccctccgaaggaagactctcctccgtgcgtcctcgtcctcaccggtcgcgttcctgaaacgcagatgtgcctcgcgccgcactgctccgaacaataaagattctacaatactagcttttatggttatgaagaggaaaaattggcagtaacctggccccacaaaccttcaaatgaacgaatcaaattaacaaccataggatgataatgcgattagttttttagccttatttctggggtaattaatcagcgaagcgatgatttttgatctattaacagatatataaatgcaaaaactgcattaaccactttaactaatactttcaacattttcggtttgtattacttcttattcaaatgtaataaaagtatcaacaaaaaattgttaatatacctctatactttaacgtcaaggagaaaaaaccccggatcggactactagcagctgtaatacgactcactatagggaatattaagcttacataatggcttcaacatggcaaagcgttcagtccatgcgccagtggattttagagaatggagataaaaggacagacccatggctactggtctactcccctatgccagtggccattatattcctcctctatcttggtgtggtctgggctgggcccaagctgatgaaacgcagggaaccagttgatctcaaggctgtactcattgtctacaacttcgccatggtctgcctgtctgtctacatgttccatgagttcttggtcacgtccttgctgtctaactacagttacctgtgtcaacctgtggattacagcactagtccactggcgatgaggatggccaaagtatgctggtggtttttcttctccaaggtcatagaattggctgacacggtgttcttcatcctgaggaagaagaacagtcagctgactttcctgcatgtctatcaccatggcaccatgatcttcaactggtgggcaggggtcaagtatctggctggaggccaatcgttcttcatcggcctgctcaatacctttgtgcacatcgtgatgtactcttactacggactggctgccctggggcctcacacgcagaagtacttatggtggaagcgctatctgacctcactgcagctgctccagtttgtcctgttgaccactcacactggctacaacctcttcactgagtgtgacttcccggactccatgaacgctgtggtgtttgcctactgtgtcagtctcattgctctcttcagcaacttctactatcagagctacctcaacaggaagagcaagaagacataaggatccactagtaacggccgccagtgtgctggaattctgcagatatccatcacactggcggccgctcgagcatgcatctagagggccgcatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggccctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagcgcttaccatctggccccagtgctgcaatgataccgcgagacccacgctcaccggctccagatttatcagcaataaaccagccagccggaagggccgagcgcagaagtggtcctgcaactttatccgcctccattcagtctattaattgttgccgggaagctagagtaagtagttcgccagttaatagtttgcgcaacgttgttggcattgctacaggcatcgtggtgtcactctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataatagtgtatcacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctagcttatcgatgataagctgtcaaagatgagaattaattccacggactatagactatactagatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgacgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatgggaagctccaccccggttgataatcagaaaagccccaaaaacaggaagattgtataagcaaatatttaaattgtaaacgttaatattttgttaaaattcgcgttaaatttttgttaaatcagctcattttttaacgaatagcccgaaatcggcaaaatcccttataaatcaaaagaatagaccgagatagggttgagtgttgttccagtttccaacaagagtccactattaaagaacgtggactccaacgtcaaagggcgaaaaagggtctatcagggcgatggcccactacgtgaaccatcaccctaatcaagttttttggggtcgaggtgccgtaaagcagtaaatcggaagggtaaacggatgcccccatttagagcttgacggggaaagccggcgaacgtggcgagaaaggaagggaagaaagcgaaaggagcgggggctagggcggtgggaagtgtaggggtcacgctgggcgtaaccaccacacccgccgcgcttaatggggcgctacagggcgcgtggggatgatccactagt

SEQ ID NO: 58 - protein, 264 aa, Oncorhynchus mykiss; identical to SEQ ID NO: 52

SEQ ID NO: 59 - DNA, 1077 bp, Thalassiosira pseudonana
  CDS (1)..(1077): Delta-5 elongase
atgtgctcatcaccgccgtcacaatccaaaacaacatccctcctagcacggtacaccaccgccgccctcctcctcctcaccctcacaacatggtgccacttcgccttcccagccgccaccgccacacccggcctcaccgccgaaatgcactcctacaaagtcccactcggtctcaccgtattctacctgctgagtctaccgtcactaaagtacgttacggacaactaccttgccaaaaagtatgatatgaagtcactcctaacggaatcaatggtgttgtacaatgtggcgcaagtgctgctcaatgggtggacggtgtatgcgattgtggatgcggtgatgaatagagaccatccgtttattggaagtagaagtttggttggggcggcgttgcatagtgggagctcgtatgcggtgtgggttcattattgtgataagtatttggagttctttgatacgtattttatggtgttgagggggaaaatggaccaggtctccttcctccacatctaccaccacacgaccatagcgtgggcatggtggatcgccctccgcttctcccccggtggagacatttacttcggggcactcctcaactccatcatccacgtcctcatgtattcctactacgcccttgccctactcaaggtcagttgtccatggaaacgatacctgactcaagctcaattattgcaattcacaagtgtggtggtttatacggggtgtacgggttatactcattactatcatacgaagcatggagcggatgagacacagcctagtttaggaacgtattatttctgttgtggagtgcaggtgtttgagatggttagtttgtttgtactcttttccatcttttataaacgatcctattcgaagaagaacaagtcaggaggaaaggatagcaagaagaatgatgatgggaataatgaggatcaatgtcacaaggctatgaaggatatatcggagggtgcgaaggaggttgtggggcatgcagcgaaggatgctggaaagttggtggctacggcgagtaaggctgtaaagaggaagggaactcgtgttactggtgccatgtag

SEQ ID NO: 60 - protein, 358 aa, Thalassiosira pseudonana
MCSSPPSQSKTTSLLARYTTAALLLLTLTTWCHFAFPAATATPGLTAEMHSYKVPLGLTVFYLLSLPSLKYVTDNYLAKKYDMKSLLTESMVLYNVAQVLLNGWTVYAIVDAVMNRDHPFIGSRSLVGAALHSGSSYAVWVHYCDKYLEFFDTYFMVLRGKMDQVSFLHIYHHTTIAWAWWIALRFSPGGDIYFGALLNSIIHVLMYSYYALALLKVSCPWKRYLTQAQLLQFTSVVVYTGCTGYTHYYHTKHGADETQPSLGTYYFCCGVQVFEMVSLFVLFSIFYKRSYSKKNKSGGKDSKKNDDGNNEDQCHKAMKDISEGAKEVVGHAAKDAGKLVATASKAVKRKGTRVTGAM

SEQ ID NO: 61 - DNA, 933 bp, Thalassiosira pseudonana
  CDS (1)..(933): Delta-5 elongase
atgcactcctacaaagtcccactcggtctcaccgtattctacctgctgagtctaccgtcactaaagtacgttacggacaactaccttgccaaaaagtatgatatgaagtcactcctaacggaatcaatggtgttgtacaatgtggcgcaagtgctgctcaatgggtggacggtgtatgcgattgtggatgcggtgatgaatagagaccatccgtttattggaagtagaagtttggttggggcggcgttgcatagtgggagctcgtatgcggtgtgggttcattattgtgataagtatttggagttctttgatacgtattttatggtgttgagggggaaaatggaccaggtctccttcctccacatctaccaccacacgaccatagcgtgggcatggtggatcgccctccgcttctcccccggtggagacatttacttcggggcactcctcaactccatcatccacgtcctcatgtattcctactacgcccttgccctactcaaggtcagttgtccatggaaacgatacctgactcaagctcaattattgcaattcacaagtgtggtggtttatacggggtgtacgggttatactcattactatcatacgaagcatggagcggatgagacacagcctagtttaggaacgtattatttctgttgtggagtgcaggtgtttgagatggttagtttgtttgtactcttttccatcttttataaacgatcctattcgaagaagaacaagtcaggaggaaaggatagcaagaagaatgatgatgggaataatgaggatcaatgtcacaaggctatgaaggatatatcggagggtgcgaaggaggttgtggggcatgcagcgaaggatgctggaaagttggtggctacggcgagtaaggctgtaaagaggaagggaactcgtgttactggtgccatgtag

SEQ ID NO: 62 - protein, 310 aa, Thalassiosira pseudonana
MHSYKVPLGLTVFYLLSLPSLKYVTDNYLAKKYDMKSLLTESMVLYNVAQVLLNGWTVYAIVDAVMNRDHPFIGSRSLVGAALHSGSSYAVWVHYCDKYLEFFDTYFMVLRGKMDQVSFLHIYHHTTIAWAWWIALRFSPGGDIYFGALLNSIIHVLMYSYYALALLKVSCPWKRYLTQAQLLQFTSVVVYTGCTGYTHYYHTKHGADETQPSLGTYYFCCGVQVFEMVSLFVLFSIFYKRSYSKKNKSGGKDSKKNDDGNNEDQCHKAMKDISEGAKEVVGHAAKDAGKLVATASKAVKRKGTRVTGAM

SEQ ID NO: 63 - DNA, 933 bp, Thalassiosira pseudonana; identical to SEQ ID NO: 61
  CDS (1)..(933): Delta-5 elongase

SEQ ID NO: 64 - protein, 310 aa, Thalassiosira pseudonana; identical to SEQ ID NO: 62

SEQ ID NO: 65 - DNA, 825 bp, Thraustochytrium aureum
  CDS (1)..(825): Delta-5 elongase
atgacgagcaacatgagcgcgtggggcgtcgccgtcgaccagacgcagcaggtcgtcgaccagatcatgggcggcgccgagccgtacaagctgacagaagggcgcatgacgaacgtcgagacgatgctggcgatcgagtgcggctacgccgccatgctgctgttcctgaccccgatcatgaagcaggccgagaagcccttcgagctcaagtccttcaagctcgcccacaacctgttcctgttcgtcctgtccgcctacatgtgcctcgagaccgtccgccaggcctaccttgcgggctactcggtgttcggcaacgacatggagaagggcagcgagccgcacgcgcacggcatggcccaaatcgtgtggatcttttacgtgtccaaggcgtacgagttcgtggacacgctgatcatgatcctgtgcaaaaagttcaaccaggtctccgtcctgcacgtgtaccaccacgccaccatctttgctatctggtttatgatcgccaagtacgccccgggcggcgacgcatactttagcgtcatcctgaactcgttcgtgcacaccgtcatgtacgcgtactacttcttctcgtcgcagggcttcgggttcgtcaagccgatcaagccgtacatcacctcgctgcagatgacgcagttcatggcgatgctcgtgcagtcgctgtacgactacctttacccgtgcgactacccgcaggggctcgtcaagctcctcggcgtgtacatgctcaccctgcttgcgctcttcggcaactttttcgtgcagagctacctcaagaagtcgaacaagcccaaggccaagtcggcctaa

SEQ ID NO: 66 - protein, 274 aa, Thraustochytrium aureum
MTSNMSAWGVAVDQTQQVVDQIMGGAEPYKLTEGRMTNVETMLAIECGYAAMLLFLTPIMKQAEKPFELKSFKLAHNLFLFVLSAYMCLETVRQAYLAGYSVFGNDMEKGSEPHAHGMAQIVWIFYVSKAYEFVDTLIMILCKKFNQVSVLHVYHHATIFAIWFMIAKYAPGGDAYFSVILNSFVHTVMYAYYFFSSQGFGFVKPIKPYITSLQMTQFMAMLVQSLYDYLYPCDYPQGLVKLLGVYMLTLLALFGNFFVQSYLKKSNKPKAKSA

SEQ ID NO: 67 - DNA, 903 bp, Ostreococcus tauri
  CDS (1)..(903): Delta-5 elongase
atgagcgcctccggtgcgctgctgcccgcgatcgcgttcgccgcgtacgcgtacgcgacgtacgcctacgcctttgagtggtcgcacgcgaatggcatcgacaacgtcgacgcgcgcgagtggatcggtgcgctgtcgttgaggctcccggcgatcgcgacgacgatgtacctgttgttctgcctggtcggaccgaggttgatggcgaagcgcgaggcgttcgacccgaaggggttcatgctggcgtacaatgcgtatcagacggcgttcaacgtcgtcgtgctcgggatgttcgcgcgagagatctcggggctggggcagcccgtgtgggggtcaaccatgccgtggagcgatagaaaatcgtttaagatcctcctcggggtgtggttgcactacaacaaccaatatttggagctattggacactgtgttcatggttgcgcgcaagaagacgaagcagttgagcttcttgcacgtttatcatcacgccctgttgatctgggcgtggtggttggtgtgtcacttgatggccacgaacgattgtatcgatgcctacttcggcgcggcgtgcaactcgttcattcacatcgtgatgtactcgtattatctcatgtcggcgctcggcattcgatgcccgtggaagcgatacatcacccaggctcaaatgctccaattcgtcattgtcttcgcgcacgccgtgttcgtgctgcgtcagaagcactgcccggtcacccttccttgggcgcaaatgttcgtcatgacgaacatgctcgtgctcttcgggaacttctacctcaaggcgtactcgaacaagtcgcgcggcgacggcgcgagttccgtgaaaccagccgagaccacgcgcgcgcccagcgtgcgacgcacgcgatctcgaaaaattgactaa

SEQ ID NO: 68 - protein, 300 aa, Ostreococcus tauri
MSASGALLPAIAFAAYAYATYAYAFEWSHANGIDNVDAREWIGALSLRLPAIATTMYLLFCLVGPRLMAKREAFDPKGFMLAYNAYQTAFNVVVLGMFAREISGLGQPVWGSTMPWSDRKSFKILLGVWLHYNNQYLELLDTVFMVARKKTKQLSFLHVYHHALLIWAWWLVCHLMATNDCIDAYFGAACNSFIHIVMYSYYLMSALGIRCPWKRYITQAQMLQFVIVFAHAVFVLRQKHCPVTLPWAQMFVMTNMLVLFGNFYLKAYSNKSRGDGASSVKPAETTRAPSVRRTRSRKID

SEQ ID NO: 69 - DNA, 879 bp, Ostreococcus tauri
  CDS (1)..(879): Delta-6 elongase
atgagtggcttacgtgcacccaactttttacacagattctggacaaagtgggactacgcgatttccaaagtcgtcttcacgtgtgccgacagttttcagtgggacatcgggccagtgagttcgagtacggcgcatttacccgccattgaatcccctaccccactggtgactagcctcttgttctacttagtcacagttttcttgtggtatggtcgtttaaccaggagttcagacaagaaaattagagagcctacgtggttaagaagattcataatatgtcataatgcgttcttgatagtcctcagtctttacatgtgccttggttgtgtggcccaagcgtatcagaatggatatactttatggggtaatgaattcaaggccacggaaactcagcttgctctctacatttacattttttacgtaagtaaaatatacgagtttgtagatacttacattatgcttctcaagaataacttgcggcaagtaagtttcctacacatttatcaccacagcacgatttcctttatttggtggatcattgctcggagggctccgggtggtgatgcttacttcagcgcggccttgaactcatgggtacacgtgtgcatgtacacctattatctattatcaacccttattggaaaagaagatcctaagcgttccaactacctttggtggggtcgccacctaacgcaaatgcagatgcttcagtttttcttcaacgtacttcaagcgttgtactgcgcttcgttctctacgtatcccaagtttttgtccaaaattctgctcgtctatatgatgagccttctcggcttgtttgggcatttctactattccaagcacatagcagcagctaagctccagaaaaaacagcagtga

SEQ ID NO: 70 - protein, 292 aa, Ostreococcus tauri
MSGLRAPNFLHRFWTKWDYAISKVVFTCADSFQWDIGPVSSSTAHLPAIESPTPLVTSLLFYLVTVFLWYGRLTRSSDKKIREPTWLRRFIICHNAFLIVLSLYMCLGCVAQAYQNGYTLWGNEFKATETQLALYIYIFYVSKIYEFVDTYIMLLKNNLRQVSFLHIYHHSTISFIWWIIARRAPGGDAYFSAALNSWVHVCMYTYYLLSTLIGKEDPKRSNYLWWGRHLTQMQMLQFFFNVLQALYCASFSTYPKFLSKILLVYMMSLLGLFGHFYYSKHIAAAKLQKKQQ

SEQ ID NO: 71 - DNA, 1362 bp, Primula farinosa
  CDS (1)..(1362): Delta-6 desaturase
atggctaacaaatctccaccaaaccccaaaacaggttacataaccagctcagacctgaaatcccacaacaaggcaggtgacctatggatatcaatccacggccaagtctacgacgtgtcctcttgggccgcccttcatccggggggcactgcccctctcatggcccttgcaggacacgacgtgaccgatgctttcctcgcgtaccatcccccttccactgcccgtctcctccctcctctctctaccaacctccttcttcaaaaccactccgtctcccccacctcctcagactaccgcaaactcctcgacaacttccataaacatggccttttccgcgccaggggccacactgcttacgccaccttcgtcttcatgatagcgatgtttctaatgagcgtgactggagtcctttgcagcgacagtgcgtgggtccatttggctagcggcggagcaatggggttcgcctggatccaatgcggatggataggtcacgactctgggcattaccggattatgtctgacaggaaatggaactggttcgcgcaaatcctaagcacaaactgcctccaggggattagtatcgggtggtggaagtggaaccataatgcgcaccacatcgcttgcaatagcctggattacgaccccgacctccagtatatccctttgctcgtcgtctcccccaagttcttcaactcccttacttctcgtttctacgacaagaagctgaacttcgacggcgtgtcgaggtttctggtttgctaccagcactggacgttttatccggtcatgtgtgtcgctaggctgaacatgctcgcgcagtcatttataacgcttttctcgagtagggaggtgtgccatagggcgcaagaggttttcggacttgccgtgttttgggtttggtttccgcttttactttcttgtttacctaattggggcgagaggattatgtttttgcttgcgagctattccgttacggggatacaacacgtgcagttcagcttgaaccatttttcttcggacgtctatgtgggcccgccagtaggtaatgactggttcaagaaacagactgccgggacacttaacatatcgtgcccggcgtggatggattggttccatggcgggttacagtttcaggtcgagcaccacttgtttccgcggatgcctaggggtcagtttaggaagatttctccttttgtgagggatttgtgtaagaaacacaacttgccttacaatatcgcgtcttttactaaagcgaatgtgtttacgcttaagacgctgagaaatacggccattgaggctcgggacctctctaatccgctcccaaagaatatggtgtgggaagctcttaaaactctcgggtga

SEQ ID NO: 72 - protein, 453 aa, Primula farinosa
MANKSPPNPKTGYITSSDLKSHNKAGDLWISIHGQVYDVSSWAALHPGGTAPLMALAGHDVTDAFLAYHPPSTARLLPPLSTNLLLQNHSVSPTSSDYRKLLDNFHKHGLFRARGHTAYATFVFMIAMFLMSVTGVLCSDSAWVHLASGGAMGFAWIQCGWIGHDSGHYRIMSDRKWNWFAQILSTNCLQGISIGWWKWNHNAHHIACNSLDYDPDLQYIPLLVVSPKFFNSLTSRFYDKKLNFDGVSRFLVCYQHWTFYPVMCVARLNMLAQSFITLFSSREVCHRAQEVFGLAVFWVWFPLLLSCLPNWGERIMFLLASYSVTGIQHVQFSLNHFSSDVYVGPPVGNDWFKKQTAGTLNISCPAWMDWFHGGLQFQVEHHLFPRMPRGQFRKISPFVRDLCKKHNLPYNIASFTKANVFTLKTLRNTAIEARDLSNPLPKNMVWEALKTLG

SEQ ID NO: 73 - DNA, 1362 bp, Primula vialii
  CDS (1)..(1362): Delta-6 desaturase
atggctaacaaatctccaccaaaccccaaaacaggttacattaccagctcagacctgaaagggcacaacaaagcaggagacctatggatatcaatccacggggaggtatacgacgtgtcctcgtgggccggccttcacccggggggcagtgcccccctcatggccctcgcaggacacgacgtaaccgacgcttttctagcgtatcatcctccttctaccgcccgcctcctccctcccctctccaccaacctcctccttcaaaaccactccgtctcccccacctcctctgactaccgcaaactcctccacaacttccataaaattggtatgttccgcgccaggggccacactgcttacgccaccttcgtcatcatgatagtgatgtttctaacgagcgtgaccggagtcctttgcagcgacagtgcgtgggtccatctggctagcggcgcagcaatggggttcgcctggatccagtgcggatggataggtcacgactctgggcattaccggattatgtctgacaggaaatggaactggttcgcgcaggtcctgagcacaaactgcctccaggggatcagtatcgggtggtggaagtggaaccataacgcccaccacattgcttgcaatagcctggactacgaccccgacctccagtatatccctttgctcgtggtctcccccaagttcttcaactcccttacttctcgtttctacgacaagaagctgaatttcgacggcgtgtcaaggtttctggtttgctaccagcactggacgttttatccagtcatgtgtgtcgctaggctaaacatgatcgcacagtcgtttataacgcttttctcgagcagggaggtgggtcatagggcgcaagagattttcggacttgctgtgttttgggtttggtttccgctcctgctctcttgcttacctaattggagcgagaggattatgtttctgctagcgagctattccgttacggggatacagcacgtgcagttcagcttgaaccatttttcttcggacgtctacgtgggcccgccagtagctaacgactggttcaagaaacagactgctgggacacttaacatatcgtgcccggcgtggatggactggttccatggcgggttgcagtttcaggtcgagcaccacttgtttccgcggatgcctaggggtcagtttaggaagatttctccttttgtgagggatttgtgtaagaaacacaacttgccttacaatatcgcgtcttttactaaagcaaacgtgttgacgcttaagacgctgagaaatacggccattgaggctcgggacctctctaatccgaccccaaagaatatggtgtgggaagccgtccacacacacggctag

SEQ ID NO: 74 - protein, 453 aa, Primula vialii
MANKSPPNPKTGYITSSDLKGHNKAGDLWISIHGEVYDVSSWAGLHPGGSAPLMALAGHDVTDAFLAYHPPSTARLLPPLSTNLLLQNHSVSPTSSDYRKLLHNFHKIGMFRARGHTAYATFVIMIVMFLTSVTGVLCSDSAWVHLASGAAMGFAWIQCGWIGHDSGHYRIMSDRKWNWFAQVLSTNCLQGISIGWWKWNHNAHHIACNSLDYDPDLQYIPLLVVSPKFFNSLTSRFYDKKLNFDGVSRFLVCYQHWTFYPVMCVARLNMIAQSFITLFSSREVGHRAQEIFGLAVFWVWFPLLLSCLPNWSERIMFLLASYSVTGIQHVQFSLNHFSSDVYVGPPVANDWFKKQTAGTLNISCPAWMDWFHGGLQFQVEHHLFPRMPRGQFRKISPFVRDLCKKHNLPYNIASFTKANVLTLKTLRNTAIEARDLSNPTPKNMVWEAVHTHG

SEQ ID NO: 75 - DNA, 903 bp, Ostreococcus tauri
  CDS (1)..(903): Delta-5 elongase
atgagcgcctccggtgcgctgctgcccgcgatcgcgtccgccgcgtacgcgtacgcgacgtacgcctacgcctttgagtggtcgcacgcgaatggcatcgacaacgtcgacgcgcgcgagtggatcggtgcgctgtcgttgaggctcccggcgatcgcgacgacgatgtacctgttgttctgcctggtcggaccgaggttgatggcgaagcgcgaggcgttcgacccgaaggggttcatgctggcgtacaatgcgtatcagacggcgttcaacgtcgtcgtgctcgggatgttcgcgcgagagatctcggggctggggcagcccgtgtgggggtcaaccatgccgtggagcgatagaaaatcgtttaagatcctcctcggggtgtggttgcactacaacaacaaatatttggagctattggacactgtgttcatggttgcgcgcaagaagacgaagcagttgagcttcttgcacgtttatcatcacgccctgttgatctgggcgtggtggttggtgtgtcacttgatggccacgaacgattgtatcgatgcctacttcggcgcggcgtgcaactcgttcattcacatcgtgatgtactcgtattatctcatgtcggcgctcggcattcgatgcccgtggaagcgatacatcacccaggctcaaatgctccaattcgtcattgtcttcgcgcacgccgtgttcgtgctgcgtcagaagcactgcccggtcacccttccttgggcgcaaatgttcgtcatgacgaacatgctcgtgctcttcgggaacttctacctcaaggcgtactcgaacaagtcgcgcggcgacggcgcgagttccgtgaaaccagccgagaccacgcgcgcgcccagcgtgcgacgcacgcgatctcgaaaaattgactaa

SEQ ID NO: 76 - protein, 300 aa, Ostreococcus tauri
MSASGALLPAIASAAYAYATYAYAFEWSHANGIDNVDAREWIGALSLRLPAIATTMYLLFCLVGPRLMAKREAFDPKGFMLAYNAYQTAFNVVVLGMFAREISGLGQPVWGSTMPWSDRKSFKILLGVWLHYNNKYLELLDTVFMVARKKTKQLSFLHVYHHALLIWAWWLVCHLMATNDCIDAYFGAACNSFIHIVMYSYYLMSALGIRCPWKRYITQAQMLQFVIVFAHAVFVLRQKHCPVTLPWAQMFVMTNMLVLFGNFYLKAYSNKSRGDGASSVKPAETTRAPSVRRTRSRKID

SEQ ID NO: 77 - DNA, 903 bp, Ostreococcus tauri
  CDS (1)..(903): Delta-5 elongase
atgagcgcctccggtgcgctgctgcccgcgatcgcgttcgccgcgtacgcgtacgcgacgtacgcctacgcctttgagtggtcgcacgcgaatggcatcgacaacgtcgacgcgcgcgagtggatcggtgcgctgtcgttgaggctcccggcgatcgcgacgacgatgtacctgttgttctgcctggtcggaccgaggttgatggcgaagcgcgaggcgttcgacccgaaggggttcatgctggcgtacaatgcgtatcagacggcgttcaacgtcgtcgtgctcgggatgttcgcgcgagagatctcggggctggggcagcccgtgtgggggtcaaccatgccgtggagcgatagaaaatcgtttaagatcctcctcggggtgtggttgcactacaacaacaaatatttggagctattggacactgtgttcatggttgcgcgcaagaagacgaagcagttgagcttcttgcacgtttatcatcacgccctgttgatctgggcgtggtggttggtgtgtcacttgatggccacgaacgattgtatcgatgcctacttcggcgcggcgtgcaactcgttcattcacatcgtgatgtactcgtattatctcatgtcggcgctcggcattcgatgcccgtggaagcgatacatcacccaggctcaaatgctccaattcgtcattgtcttcgcgcacgccgtgttcgtgctgcgtcagaagcactgcccggtcacccttccttgggcgcaaatgttcgtcatgacgaacatgctcgtgctcttcgggaacttctacctcaaggcgtactcgaacaagtcgcgcggcgacggcgcgagttccgtgaaaccagccgagaccacgcgcgcgcccagcgtgcgacgcacgcgatctcgaaaaattgactaa

SEQ ID NO: 78 - protein, 300 aa, Ostreococcus tauri
MSASGALLPAIAFAAYAYATYAYAFEWSHANGIDNVDAREWIGALSLRLPAIATTMYLLFCLVGPRLMAKREAFDPKGFMLAYNAYQTAFNVVVLGMFAREISGLGQPVWGSTMPWSDRKSFKILLGVWLHYNNKYLELLDTVFMVARKKTKQLSFLHVYHHALLIWAWWLVCHLMATNDCIDAYFGAACNSFIHIVMYSYYLMSALGIRCPWKRYITQAQMLQFVIVFAHAVFVLRQKHCPVTLPWAQMFVMTNMLVLFGNFYLKAYSNKSRGDGASSVKPAETTRAPSVRRTRSRKID

SEQ ID NO: 79 - DNA, 903 bp, Ostreococcus tauri
  CDS (1)..(903): Delta-5 elongase
atgagcgcctccggtgcgctgctgcccgcgatcgcgtccgccgcgtacgcgtacgcgacgtacgcctacgcctttgagtggtcgcacgcgaatggcatcgacaacgtcgacgcgcgcgagtggatcggtgcgctgtcgttgaggctcccggcgatcgcgacgacgatgtacctgttgttctgcctggtcggaccgaggttgatggcgaagcgcgaggcgttcgacccgaaggggttcatgctggcgtacaatgcgtatcagacggcgttcaacgtcgtcgtgctcgggatgttcgcgcgagagatctcggggctggggcagcccgtgtgggggtcaaccatgccgtggagcgatagaaaatcgtttaagatcctcctcggggtgtggttgcactacaacaaccaatatttggagctattggacactgtgttcatggttgcgcgcaagaagacgaagcagttgagcttcttgcacgtttatcatcacgccctgttgatctgggcgtggtggttggtgtgtcacttgatggccacgaacgattgtatcgatgcctacttcggcgcggcgtgcaactcgttcattcacatcgtgatgtactcgtattatctcatgtcggcgctcggcattcgatgcccgtggaagcgatacatcacccaggctcaaatgctccaattcgtcattgtcttcgcgcacgccgtgttcgtgctgcgtcagaagcactgcccggtcacccttccttgggcgcaaatgttcgtcatgacgaacatgctcgtgctcttcgggaacttctacctcaaggcgtactcgaacaagtcgcgcggcgacggcgcgagttccgtgaaaccagccgagaccacgcgcgcgcccagcgtgcgacgcacgcgatctcgaaaaattgactaa

SEQ ID NO: 80 - protein, 300 aa, Ostreococcus tauri
MSASGALLPAIASAAYAYATYAYAFEWSHANGIDNVDAREWIGALSLRLPAIATTMYLLFCLVGPRLMAKREAFDPKGFMLAYNAYQTAFNVVVLGMFAREISGLGQPVWGSTMPWSDRKSFKILLGVWLHYNNQYLELLDTVFMVARKKTKQLSFLHVYHHALLIWAWWLVCHLMATNDCIDAYFGAACNSFIHIVMYSYYLMSALGIRCPWKRYITQAQMLQFVIVFAHAVFVLRQKHCPVTLPWAQMFVMTNMLVLFGNFYLKAYSNKSRGDGASSVKPAETTRAPSVRRTRSRKID

SEQ ID NO: 81 - DNA, 879 bp, Ostreococcus tauri
  CDS (1)..(879): Delta-6 elongase
atgagtggcttacgtgcacccaactttttacacagattctggacaaagtgggactacgcgatttccaaagtcgtcttcacgtgtgccgacagttttcagtgggacatcgggccagtgagttcgagtacggcgcatttacccgccattgaatcccctaccccactggtgactagcctcttgttctacttagtcacagttttcttgtggtatggtcgtttaaccaggagttcagacaagaaaattagagagcctacgtggttaagaagattcataatatgtcataatgcgttcttgatagtcctcagtctttacatgtgccttggttgtgtggcccaagcgtatcagaatggatatactttatggggtaatgaattcaaggccacggaaactcagcttgctctctacatttacattttttacgtaagtaaaatatacgagtttgtagatacttacattatgcttctcaagaataacttgcggcaagtaagattcctacacacttatcaccacagcacgatttcctttatttggtggatcattgctcggagggctccgggtggtgatgcttacttcagcgcggccttgaactcatgggtacacgtgtgcatgtacacctattatctattatcaacccttattggaaaagaagatcctaagcgttccaactacctttggtggggtcgccacctaacgcaaatgcagatgcttcagtttttcttcaacgtacttcaagcgttgtactgcgcttcgttctctacgtatcccaagtttttgtccaaaattctgctcgtctatatgatgagccttctcggcttgtttgggcatttctactattccaagcacatagcagcagctaagctccagaaaaaacagcagtga

SEQ ID NO: 82 - protein, 292 aa, Ostreococcus tauri
MSGLRAPNFLHRFWTKWDYAISKVVFTCADSFQWDIGPVSSSTAHLPAIESPTPLVTSLLFYLVTVFLWYGRLTRSSDKKIREPTWLRRFIICHNAFLIVLSLYMCLGCVAQAYQNGYTLWGNEFKATETQLALYIYIFYVSKIYEFVDTYIMLLKNNLRQVRFLHTYHHSTISFIWWIIARRAPGGDAYFSAALNSWVHVCMYTYYLLSTLIGKEDPKRSNYLWWGRHLTQMQMLQFFFNVLQALYCASFSTYPKFLSKILLVYMMSLLGLFGHFYYSKHIAAAKLQKKQQ

SEQ ID NO: 83 - DNA, 831 bp, Thraustochytrium sp.
  CDS (1)..(831): Delta-5 elongase
atggacgtcgtcgagcagcaatggcgccgcttcgtggacgccgtggacaacggaatcgtggagttcatggagcatgagaagcccaacaagctgaacgagggcaagctcttcacctcgaccgaggagatgatggcgcttatcgtcggctacctggcgttcgtggtcctcgggtccgccttcatgaaggcctttgtcgataagcctttcgagctcaagttcctcaagctcgtgcacaacatcttcctcaccggtctgtccatgtacatggccaccgagtgcgcgcgccaggcatacctcggcggctacaagctctttggcaacccgatggagaagggcaccgagtcgcacgccccgggcatggccaacatcatctacatcttctacgtgagcaagttcctcgaattcctcgacaccgtcttcatgatcctcggcaagaagtggaagcagctcagctttctccacgtctaccaccacgcgagcatcagcttcatctggggcatcatcgcccgcttcgcgcccggtggcgacgcctacttctctaccatcctcaacagcagcgtgcatgtcgtgctctacggctactacgcctcgaccaccctcggctacaccttcatgcgcccgctgcgcccgtacattaccaccattcagctcacgcagttcatggccatggtcgtccagtccgtctatgactactacaacccctgcgactacccgcagcccctcgtcaagctgctcttctggtacatgctcaccatgctcggcctcttcggcaacttcttcgtgcagcagtacctcaagcccaaggcgcccaagaagcagaagaccatctaa

SEQ ID NO: 84 - protein, 276 aa, Thraustochytrium sp.
MDVVEQQWRRFVDAVDNGIVEFMEHEKPNKLNEGKLFTSTEEMMALIVGYLAFVVLGSAFMKAFVDKPFELKFLKLVHNIFLTGLSMYMATECARQAYLGGYKLFGNPMEKGTESHAPGMANIIYIFYVSKFLEFLDTVFMILGKKWKQLSFLHVYHHASISFIWGIIARFAPGGDAYFSTILNSSVHVVLYGYYASTTLGYTFMRPLRPYITTIQLTQFMAMVVQSVYDYYNPCDYPQPLVKLLFWYMLTMLGLFGNFFVQQYLKPKAPKKQKTI

SEQ ID NO: 85 - DNA, 1077 bp, Thalassiosira pseudonana
  CDS (1)..(1077): Delta-5 elongase
atgtgctcaccaccgccgtcacaatccaaaacaacatccctcctagcacggtacaccaccgccgccctcctcctcctcaccctcacaacgtggtgccacttcgccttcccagccgccaccgccacacccggcctcaccgccgaaatgcactcctacaaagtcccactcggtctcaccgtattctacctgctgagtctaccgtcactaaagtacgttacggacaactaccttgccaaaaagtatgatatgaagtcactcctgacggaatcaatggtgttgtacaatgtggcgcaagtgctgctcaatgggtggacggtgtatgcgattgtggatgcggtgatgaatagagaccatccttttattggaagtagaagtttggttggggcggcgttgcatagtgggagctcgtatgcggtgtgggttcattattgtgataagtatttggagttctttgatacgtattttatggtgttgagggggaaaatggaccaggtctccttcctccacatctaccaccacacgaccatagcgtgggcatggtggatcgccctccgcttctcccccggcggagacatttacttcggggcactcctcaactccatcatccacgtcctcatgtattcctactacgcccttgccctactcaaggtcagttgtccatggaaacgatacttgactcaagctcaattattgcaattcacaagtgtggtggtttatacggggtgtacgggttatactcattactatcatacgaagcatggagcggatgagacacagcctagtttaggaacgtattatttctgttgtggagtgcaggtgtttgagatggttagtttgtttgtactcttttccatcttttataaacgatcctattcgaagaagaacaagtcaggaggaaaggatagcaagaagaatgatgatgggaataatgaggatcaatgtcacaaggctatgaaggatatatcggagggtgcgaaggaggttgtggggcatgcagcgaaggatgctggaaagttggtggctacggcgagtaaggctgtaaagaggaagggaactcgtgttactggtgccatgtag

SEQ ID NO: 86 - protein, 358 aa, Thalassiosira pseudonana
MCSPPPSQSKTTSLLARYTTAALLLLTLTTWCHFAFPAATATPGLTAEMHSYKVPLGLTVFYLLSLPSLKYVTDNYLAKKYDMKSLLTESMVLYNVAQVLLNGWTVYAIVDAVMNRDHPFIGSRSLVGAALHSGSSYAVWVHYCDKYLEFFDTYFMVLRGKMDQVSFLHIYHHTTIAWAWWIALRFSPGGDIYFGALLNSIIHVLMYSYYALALLKVSCPWKRYLTQAQLLQFTSVVVYTGCTGYTHYYHTKHGADETQPSLGTYYFCCGVQVFEMVSLFVLFSIFYKRSYSKKNKSGGKDSKKNDDGNNEDQCHKAMKDISEGAKEVVGHAAKDAGKLVATASKAVKRKGTRVTGAM

SEQ ID NO: 87 - DNA, 1086 bp, Phytophthora infestans
  CDS (1)..(1086): Omega-3 desaturase
atggcgacgaaggaggcgtatgtgttccccactctgacggagatcaagcggtcgctacctaaagactgtttcgaggcttcggtgcctctgtcgctctactacaccgtgcgttgtctggtgatcgcggtggctctaaccttcggtctcaactacgctcgcgctctgcccgaggtcgagagcttctgggctctggacgccgcactctgcacgggctacatcttgctgcagggcatcgtgttctggggcttcttcacggtgggccacgatgccggccacggcgccttctcgcgctaccacctgcttaacttcgtggtgggcactttcatgcactcgctcatcctcacgcccttcgagtcgtggaagctcacgcaccgtcaccaccacaagaacacgggcaacattgaccgtgacgaggtcttctacccgcaacgcaaggccgacgaccacccgctgtctcgcaacctgattctggcgctcggggcagcgtggctcgcctatttggtcgagggcttccctcctcgtaaggtcaaccacttcaacccgttcgagcctctgttcgtgcgtcaggtgtcagctgtggtaatctctcttctcgcccacttcttcgtggccggactctccatctatctgagcctccagctgggccttaagacgatggcaatctactactatggacctgtttttgtgttcggcagcatgctggtcattaccaccttcctacaccacaatgatgaggagaccccatggtacgccgactcggagtggacgtacgtcaagggcaacctctcgtccgtggaccgatcgtacggcgcgctcattgacaacctgagccacaacatcggcacgcaccagatccaccaccttttccctatcattccgcactacaaactcaagaaagccactgcggccttccaccaggctttccctgagctcgtgcgcaagagcgacgagccaattatcaaggctttcttccgggttggacgtctctacgcaaactacggcgttgtggaccaggaggcgaagctcttcacgctaaaggaagccaaggcggcgaccgaggcggcggccaagaccaagtccacgtaa

SEQ ID NO: 88 - protein, 361 aa, Phytophthora infestans
MATKEAYVFPTLTEIKRSLPKDCFEASVPLSLYYTVRCLVIAVALTFGLNYARALPEVESFWALDAALCTGYILLQGIVFWGFFTVGHDAGHGAFSRYHLLNFVVGTFMHSLILTPFESWKLTHRHHHKNTGNIDRDEVFYPQRKADDHPLSRNLILALGAAWLAYLVEGFPPRKVNHFNPFEPLFVRQVSAVVISLLAHFFVAGLSIYLSLQLGLKTMAIYYYGPVFVFGSMLVITTFLHHNDEETPWYADSEWTYVKGNLSSVDRSYGALIDNLSHNIGTHQIHHLFPIIPHYKLKKATAAFHQAFPELVRKSDEPIIKAFFRVGRLYANYGVVDQEAKLFTLKEAKAATEAAAKTKST

SEQ ID NO: 89 - DNA, 1371 bp, Ostreococcus tauri
  CDS (1)..(1371): Delta-6 desaturase
atgtgcgtggagacggaaaataacgatgggatccccacggtggagatcgcgttcgacggtgagcgcgagcgggcggaggcaaacgtgaagctgtccgcggagaagatggagccggcggcgctggcgaagacgttcgcgaggcggtacgtcgtgatcgagggggtggagtacgatgtgacggattttaagcacccgggaggaacggttattttctatgcgttgtcaaacaccggggcggacgcgacggaagcgttcaaggagtttcatcatcggtcgagaaaggcgaggaaagccttggcggcgctcccgtctcgaccggccaagacggccaaggtggacgacgcggagatgctccaagatttcgccaagtggcggaaagaattggagagagatggattcttcaagccctctccggcgcacgtggcgtatcgcttcgccgagctcgcggcgatgtacgctctcgggacgtacctgatgtacgctcgatacgtcgtctcctcggtgctcgtgtacgcttgctttttcggcgcccgatgcggttgggtgcagcacgagggcggacacagctcgctgacgggcaacatttggtgggacaagcgcatccaggccttcacagccgggttcggtctcgccggtagcggcgacatgtggaactcgatgcacaacaagcatcacgcgacgcctcaaaaggttcgtcacgacatggatctggacaccacccccgcggtggcgttcttcaacaccgcggtggaagacaatcgtccccgtggctttagcaagtactggttgcgccttcaggcgtggaccttcatccccgtgacgtccggcttggtgctccttttctggatgtttttcctccacccctccaaggctttgaagggtggcaagtacgaagagttggtgtggatgctcgccgcgcacgtcatccgcacgtggacgatcaaggcggtgaccggattcaccgcgatgcagtcctacggcttatttttggcgacgagctgggtgagcggctgctatctgtttgcacacttctccacgtcgcacacgcacctggatgtggtgcccgcggacgagcatctctcctgggttcgatacgccgtcgatcacacgatcgacatcgatccgagtcaaggttgggtgaactggttgatgggctacctcaactgccaagtcatccaccacctctttccgagcatgccgcagttccgccagcccgaggtatctcgccgcttcgtcgcctttgcgaaaaagtggaacctcaactacaaggtcatgacctacgccggtgcgtggaaggcaacgctcggaaacctcgacaacgtgggtaagcactactacgtgcacggccaacactccggaaagacggcgtaa

SEQ ID NO: 90 - protein, 456 aa, Ostreococcus tauri
MCVETENNDGIPTVEIAFDGERERAEANVKLSAEKMEPAALAKTFARRYVVIEGVEYDVTDFKHPGGTVIFYALSNTGADATEAFKEFHHRSRKARKALAALPSRPAKTAKVDDAEMLQDFAKWRKELERDGFFKPSPAHVAYRFAELAAMYALGTYLMYARYVVSSVLVYACFFGARCGWVQHEGGHSSLTGNIWWDKRIQAFTAGFGLAGSGDMWNSMHNKHHATPQKVRHDMDLDTTPAVAFFNTAVEDNRPRGFSKYWLRLQAWTFIPVTSGLVLLFWMFFLHPSKALKGGKYEELVWMLAAHVIRTWTIKAVTGFTAMQSYGLFLATSWVSGCYLFAHFSTSHTHLDVVPADEHLSWVRYAVDHTIDIDPSQGWVNWLMGYLNCQVIHHLFPSMPQFRQPEVSRRFVAFAKKWNLNYKVMTYAGAWKATLGNLDNVGKHYYVHGQHSGKTA

SEQ ID NO: 91 - DNA, 606 bp, Ostreococcus tauri
  CDS (1)..(606): Delta-5 desaturase
atgtacggtttgctatcgctcaagtcgtgcttcgtcgacgatttcaacgcctacttctccggacgcatcggctgggtcaaggtgatgaagttcacccgcggcgaggcgatcgcattttggggcaccaagctcttgtgggccgcgtattacctcgcgttgccgctaaagatgtcgcatcggccgctcggagaactcctcgcactctgggccgtcaccgagttcgtcaccggatggctgttggcgttcatgttccaagtcgcccacgtcgtcggcgaggttcacttcttcaccctcgacgcgaagaaccgcgtgaacttgggatggggagaggcacagctcatgtcgagcgcggatttcgcccacggatccaagttttggacgcacttctccggaggcttaaactaccaagtcgtccaccatctcttcccgggcgtctgccacgtgcactatcccgcgctcgcgccaattattaaggcggcagctgagaagcacggcctccactaccagatttaccccacgttttggtccgccctgcgcgcgcacttccggcacctcgccaacgtcggccgcgccgcgtacgtaccgtccctccaaaccgtcggatga

SEQ ID NO: 92 - protein, 201 aa, Ostreococcus tauri
MYGLLSLKSCFVDDFNAYFSGRIGWVKVMKFTRGEAIAFWGTKLLWAAYYLALPLKMSHRPLGELLALWAVTEFVTGWLLAFMFQVAHVVGEVHFFTLDAKNRVNLGWGEAQLMSSADFAHGSKFWTHFSGGLNYQVVHHLFPGVCHVHYPALAPIIKAAAEKHGLHYQIYPTFWSALRAHFRHLANVGRAAYVPSLQTVG

SEQ ID NO: 93 - DNA, 714 bp, Ostreococcus tauri
  CDS (1)..(714): Delta-5 desaturase
atggtgagccatcactcgtactgtaacgacgcggatttggatcaggatgtgtacaccgcactgccgctcctgcgcctggacccgtctcaggagttgaagtggtttcatcgataccaggcgttttacgccccgctcatgtggccgtttttgtggctcgcggcgcagtttggcgacgcgcagaacatcctgatcgaccgagcgtcgccgggcgtcgcgtacaagggattgatggcgaacgaggtcgcgctgtacgttctcggtaaggttttacactttggtcttctcctcggcgttcctgcgtacttgcacggattgtccaacgcgatcgttccattcttggcgtacggcgcattcggctccttcgtcctgtgctggttcttcatcgtcagccataacctcgaagcgctgacacccgttaaccttaacaagtccacgaagaacgactggggggcgtggcagatcgagacatcggcgtcttggggcaacgcgttctggagcttcttctctggaggtctgaacctgcaaatcgagcaccacctcttcccgggcatggcgcacaacctgtacccgaagatggtgccgatcatcaaggacgagtgtgcgaaagcgggcgttcgctacaccggttacggtggctacaccggcctgctcccgatcacccgcgacatgttctcctacctccataagtgtggccgaacggcgaaactagcctaa

SEQ ID NO: 94 - protein, 237 aa, Ostreococcus tauri
MVSHHSYCNDADLDQDVYTALPLLRLDPSQELKWFHRYQAFYAPLMWPFLWLAAQFGDAQNILIDRASPGVAYKGLMANEVALYVLGKVLHFGLLLGVPAYLHGLSNAIVPFLAYGAFGSFVLCWFFIVSHNLEALTPVNLNKSTKNDWGAWQIETSASWGNAFWSFFSGGLNLQIEHHLFPGMAHNLYPKMVPIIKDECAKAGVRYTGYGGYTGLLPITRDMFSYLHKCGRTAKLA

SEQ ID NO: 95 - DNA, 1611 bp, Ostreococcus tauri
  CDS (1)..(1611): Delta-4 desaturase
atgtacctcggacgcggccgtctcgagagcgggacgacgcgagggatgatgcggacgcacgcgcggcgaccgtcgacgacgtcgaatccgtgcgcgcggtcacgcgtgcgtaagacgacggagcgatcgctcgcgcgagtgcgacgatcgacgagtgagaagggaagcgcgctcgtgctcgagcgagagagcgaacgggagaaggaggagggagggaaagcgcgagcggagggattgcgattccaacgcccggacgtcgccgcgccggggggagcggatccttggaacgacgagaagtggacaaagaccaagtggacggtattcagagacgtcgcgtacgatctcgatcctttcttcgctcgacaccccggaggagactggctcctgaacttggccgtgggacgagactgcaccgcgctcatcgaatcctatcacttgcgaccagaggtggcgacggctcgtttcagaatgctgcccaaactcgaggattttcccgtcgaggccgtgcccaagtccccgagaccgaacgattcgccgttatacaacaacattcgcaaccgagtccgcgaagagctcttcccagaggagggaaagaatatgcacagacagggcggcgaccacggcgacggtgacgattctgggtttcgccgccttttgcttatgccgtgtacctattcccttccgggggttcctttccggctgcctcctcgggtctcgcgggggcgtggattggtctcacgattcaggcactgcgccaaccacggcgcgatgtctccttcgccggccgttaacggcgtcctcggtttgacgaacgatctcatcggcggctcgtccttgatgtggagatatcaccaccaagtcagccaccacattcattgcaacgacaacgccatggatcaagacgtgtacacggcgatgccattattgcgtttcgacgctcgccggcccaagtcctggtaccatcgcttccagcagtggtacatgtttttagcgttcccgttgttgcaggttgccttccaagtcggagacattgccgcactgttcacgcgtgataccgaaggcgctaagcttcacggggcgacgacgtgggagcttaccacggttgtcctcggtaagattgtgcacttcggtcttttgttggggccgttgatgaaccacgcggtgagttctgttttgctggggatcgtcggtttcatggcgtgccaaggtatagttctggcgtgcacgtttgctgtgagtcacaatgtcgcggaggcgaagatacctgaggacaccggaggagaagcctgggagagagattggggtgtccagcagttggtgactagcgccgactggggtggaaagataggtaacttcttcacgggtggcctcaacttgcaagttgagcaccacttgtttccggcgatttgcttcgtccactacccggacatcgcgaagatcgtgaaggaagaagcggccaagctcaacatcccttacgcgtcttacaggactcttcctggtattttcgtccaattctggagatttatgaaggacatgggcacggctgagcaaattggtgaagttccattgccgaagattcccaacccgcagctcgcgccgaagctcgcttag

SEQ ID NO: 96 - protein, 536 aa, Ostreococcus tauri
MYLGRGRLESGTTRGMMRTHARRPSTTSNPCARSRVRKTTERSLARVRRSTSEKGSALVLERESEREKEEGGKARAEGLRFQRPDVAAPGGADPWNDEKWTKTKWTVFRDVAYDLDPFFARHPGGDWLLNLAVGRDCTALIESYHLRPEVATARFRMLPKLEDFPVEAVPKSPRPNDSPLYNNIRNRVREELFPEEGKNMHRQGGDHGDGDDSGFRRLLLMPCTYSLPGVPFRLPPRVSRGRGLVSRFRHCANHGAMSPSPAVNGVLGLTNDLIGGSSLMWRYHHQVSHHIHCNDNAMDQDVYTAMPLLRFDARRPKSWYHRFQQWYMFLAFPLLQVAFQVGDIAALFTRDTEGAKLHGATTWELTTVVLGKIVHFGLLLGPLMNHAVSSVLLGIVGFMACQGIVLACTFAVSHNVAEAKIPEDTGGEAWERDWGVQQLVTSADWGGKIGNFFTGGLNLQVEHHLFPAICFVHYPDIAKIVKEEAAKLNIPYASYRTLPGIFVQFWRFMKDMGTAEQIGEVPLPKIPNPQLAPKLA

SEQ ID NO: 97 - DNA, 1455 bp, Thalassiosira pseudonana
  CDS (1)..(1455): Delta-6 desaturase
atgggaaaaggaggagacgcagccgcagctaccaagcgtagtggagcattgaaattggcggagaagccgcagaagtacacttggcaggaggtgaagaagcacatcacccccgacgatgcctgggtagtccaccaaaacaaagtctacgacgtctccaactggtacgaccaccccggtggagccgtggtgttcacccacgccggagacgacatgacggacatcttcgccgccttccacgcccaaggctctcaggccatgatgaagaagttttacattggagatttgattccggagagtgtggagcataaggatcaaagacagttggatttcgagaagggatatcgtgatttacgggccaagcttgtcatgatggggatgttcaagtcgagtaagatgtattatgcatacaagtgctcgttcaatatgtgcatgtggttggtggcggtggccatggtgtactactcggacagtttggcaatgcacattggatcggctctcttgttgggattgttctggcagcagtgtggatggcttgcgcacgactttcttcaccaccaagtctttaagcaacgaaagtacggagatctcgttggcatcttttggggagatctcatgcaggggttctcgatgcagtggtggaagaacaagcacaatggccaccatgctgttcccaacttgcacaactcttccttggacagtcaggatggtgatcccgatattgataccatgccactccttgcttggagtctcaagcaggctcagagtttcagagagatcaataagggaaaggacagtaccttcgtcaagtacgctatcaaattccaggcattcacatacttccccatcctcctcttggctcgcatctcttggttgaatgaatccttcaaaactgcattcggactcggagctgcctcggagaatgccaagttggagttggagaagcgtggacttcagtacccacttttggagaagcttggaatcacccttcattacacttggatgttcgtcctctcttccggatttggaaggtggtctcttccatattccatcatgtatttcttcactgccacatgctcctcgggacttttcctcgcattggtctttggattgggacacaacggtatgtcagtgtacgatgccaccacccgacctgacttctggcaactccaagtcaccactacacgtaacatcattggtggacacggcattccccaattctttgtggattggttctgcggtggattgcaataccaagtggatcaccacctcttccccatgatgcctagaaacaatatcgcgaaatgccacaagcttgtggagtcattctgtaaggagtggggtgtgaagtaccatgaggccgatatgtgggatggtaccgtggaagtgttgcaacatctctccaaggtgtcggatgatttccttgtggagatggtgaaggatttccctgccatgtaa

SEQ ID NO: 98 - protein, 484 aa, Thalassiosira pseudonana
MGKGGDAAAATKRSGALKLAEKPQKYTWQEVKKHITPDDAWVVHQNKVYDVSNWYDHPGGAVVFTHAGDDMTDIFAAFHAQGSQAMMKKFYIGDLIPESVEHKDQRQLDFEKGYRDLRAKLVMMGMFKSSKMYYAYKCSFNMCMWLVAVAMVYYSDSLAMHIGSALLLGLFWQQCGWLAHDFLHHQVFKQRKYGDLVGIFWGDLMQGFSMQWWKNKHNGHHAVPNLHNSSLDSQDGDPDIDTMPLLAWSLKQAQSFREINKGKDSTFVKYAIKFQAFTYFPILLLARISWLNESFKTAFGLGAASENAKLELEKRGLQYPLLEKLGITLHYTWMFVLSSGFGRWSLPYSIMYFFTATCSSGLFLALVFGLGHNGMSVYDATTRPDFWQLQVTTTRNIIGGHGIPQFFVDWFCGGLQYQVDHHLFPMMPRNNIAKCHKLVESFCKEWGVKYHEADMWDGTVEVLQHLSKVSDDFLVEMVKDFPAM

SEQ ID NO: 99 - DNA, 1431 bp, Thalassiosira pseudonana
  CDS (1)..(1431): Delta-5 desaturase
atgccccccaacgccgatatctcccgcatccgcaaccgcatccccaccaaaacaggtaccgttgcctctgccgacaacaacgaccccgccacccaatccgtccgaaccctcaaatctctcaagggcaacgaggtcgtcatcaacggcacaatttatgacattgctgactttgtccatcctggaggagaggttgtcaagttctttggtgggaatgatgttactattcagtataatatgattcatccgtatcatacggggaaacatctggagaagatgaaggctgttggaaaggttgtagattggcagtcggactacaagttcgacaccccctttgaacgagagatcaaatcagaagtgttcaagatcgtacgtcgcgggcgtgagttcggcacaacaggctacttcctccgtgcctttttctacatcgctctcttcttcaccatgcaatacactttcgccacatgcaccaccttcaccacctacgatcactggtatcagagtggtgtattcatcgcaattgtgtttggtatttcacaggcattcattgggttgaatgtccagcacgatgccaatcacggagctgccagtaagcgtccctgggtgaatgacttgttgggatttggaacggatttgattggatctaacaaatggaattggatggcacagcattggactcatcacgcttacactaaccatagtgagaaggatcccgatagcttcagctcggaacctatgtttgcattcaatgactatcccattggacacccgaagagaaagtggtggcataggttccagggagggtacttcctcttcatgcttggactttactggctctcgactgtattcaatccgcaattcattgatcttcgtcaacgtggggctcagtacgtcggaattcaaatggagaatgatttcattgtcaagaggaggaagtacgccgttgcattgaggatgatgtacatttacttgaacattgtcagccccttcatgaacaatggtttgagctggtctacctttggaatcatcatgttgatgggaatcagcgagagtctcactctcagtgtgctcttctcgttgtctcacaacttcatcaattcggatcgtgatcctacggctgacttcaaaaagaccggagaacaagtgtgctggttcaagtcgcaggtggagacttcgtctacctatgggggttttatttccggatgtcttacgggaggactcaactttcaggtggaacatcatctctttccccgtatgagcagtgcttggtatccttacattgcacctacggttcgtgaggtttgcaagaagcacggggtgaactacgcttattatccttggattgggcagaatttggtatcaacattcaaatacatgcatcgcgctggtagtggagccaactgggagctcaagccgttgtctggaagtgcctaa

SEQ ID NO: 100 - protein, 476 aa, Thalassiosira pseudonana
MPPNADISRIRNRIPTKTGTVASADNNDPATQSVRTLKSLKGNEVVINGTIYDIADFVHPGGEVVKFFGGNDVTIQYNMIHPYHTGKHLEKMKAVGKVVDWQSDYKFDTPFEREIKSEVFKIVRRGREFGTTGYFLRAFFYIALFFTMQYTFATCTTFTTYDHWYQSGVFIAIVFGISQAFIGLNVQHDANHGAASKRPWVNDLLGFGTDLIGSNKWNWMAQHWTHHAYTNHSEKDPDSFSSEPMFAFNDYPIGHPKRKWWHRFQGGYFLFMLGLYWLSTVFNPQFIDLRQRGAQYVGIQMENDFIVKRRKYAVALRMMYIYLNIVSPFMNNGLSWSTFGIIMLMGISESLTLSVLFSLSHNFINSDRDPTADFKKTGEQVCWFKSQVETSSTYGGFISGCLTGGLNFQVEHHLFPRMSSAWYPYIAPTVREVCKKHGVNYAYYPWIGQNLVSTFKYMHRAGSGANWELKPLSGSA

SEQ ID NO: 101 - DNA, 1449 bp, Thalassiosira pseudonana
  CDS (1)..(1449): Delta-5 desaturase
atgccacccaacgccgaggtcaaaaacctccgttcacgttccatcccaacgaagaagtccagttcatcgtcatccaccgcgaacgacgatccggctacccaatccacctcacctgtgaaccgaaccctcaagtctttgaatggaaacgaaatagctattgacggtgtcatctatgatattgatggctttgtccatcctggaggagaggttattagcttctttggaggcaacgatgtgactgtacagtacaaaatgattcatccgtatcataatagtaagcatctcgagaagatgagagccgttggaaagattgcagactactccacagagtacaagttcgacacaccctttgaacgagagatcaaatccgaagtgttcaaaatcgtccgtcgaggacgtgaattcggtacaacaggatatttcctccgtgccttcttctacattgctctcttcttcaccatgcaatacaccttcgccacatgcactaccttcaccacctacgatcattggtatcaaagtggtgtattcatcgccattgtgtttggtatctcacaagctttcattgggttgaatgtacaacatgatgccaatcacggagctgctagcaaacgaccttgggtgaatgatctccttggatctggagctgatctcatcggtggatgcaaatggaactggttggctcagcattggactcatcatgcgtataccaatcacgctgataaagatcctgatagctttagttccgagccggtcttcaactttaacgattatcccattggtcaccccaaaagaaagtggtggcataggttccaagggctctacttcctaatcatgctgagtttctattgggtatcgatggtattcaacccacaagttatcgacctccgtcatgctggagctgcctacgttggatttcagatggagaacgactttatcgtcaaacggagaaagtatgcaatggcacttcgtgcaatgtacttctatttcaacatctattgtccgattgtcaacaatggattgacttggtcgacagttggaatcatcctcttaatgggagttagcgaaagcttcatgctctccggtctattcgtactctcacacaactttgaaaattccgaacgtgatcctacctctgagtatcgcaagactggtgagcaagtatgttggttcaagtctcaagtggagacttcttctacctacggaggtatcgttgctgggtgtctcactggtggactcaactttcaagtggagcatcatttgttcccgaggatgagcagtgcttggtatcctttcatcgcgccgaaggttagagagatttgtaagaagcatggagttagatacgcttactatccgtacatctggcagaacttgcattctaccgtgagttacatgcatgggacgggaacgggagctagatgggagcttcagccgttgtctggaagggcgtag

SEQ ID NO: 102 - protein, 482 aa, Thalassiosira pseudonana
MPPNAEVKNLRSRSIPTKKSSSSSSTANDDPATQSTSPVNRTLKSLNGNEIAIDGVIYDIDGFVHPGGEVISFFGGNDVTVQYKMIHPYHNSKHLEKMRAVGKIADYSTEYKFDTPFEREIKSEVFKIVRRGREFGTTGYFLRAFFYIALFFTMQYTFATCTTFTTYDHWYQSGVFIAIVFGISQAFIGLNVQHDANHGAASKRPWVNDLLGSGADLIGGCKWNWLAQHWTHHAYTNHADKDPDSFSSEPVFNFNDYPIGHPKRKWWHRFQGLYFLIMLSFYWVSMVFNPQVIDLRHAGAAYVGFQMENDFIVKRRKYAMALRAMYFYFNIYCPIVNNGLTWSTVGIILLMGVSESFMLSGLFVLSHNFENSERDPTSEYRKTGEQVCWFKSQVETSSTYGGIVAGCLTGGLNFQVEHHLFPRMSSAWYPFIAPKVREICKKHGVRYAYYPYIWQNLHSTVSYMHGTGTGARWELQPLSGRA

SEQ ID NO: 103 - DNA, 1512 bp, Thalassiosira pseudonana
  CDS (1)..(1512): Delta-4 desaturase
atgtgcaacggcaacctcccagcatccaccgcacagctcaagtccacctcgaagccccagcagcaacatgagcatcgcaccatctccaagtccgagctcgcccaacacaacacgcccaaatcagcatggtgtgccgtccactccactcccgccaccgacccatcccactccaacaacaaacaacacgcacacctagtcctcgacattaccgactttgcgtcccgccatccagggggagacctcatcctcctcgcttccggcaaagacgcctcggtgctgtttgaaacataccatccacgtggagttccgacgtctctcattcaaaagctgcagattggagtgatggaggaggaggcgtttcgggattcgttttacagttggactgattctgacttttatactgtgttgaagaggagggttgtggagcggttggaggagagggggttggacaggaggggatcgaaagagatttggatcaaggctttgttcttgttggttggattttggtactgtttgtacaagatgtatactacgtcggatatcgatcagtacggtattgccattgcctattctattggaatgggaacctttgcggcattcatcggcacgtgtattcaacacgatggaaatcacggtgcattcgctcagaacaagttactcaacaagttggctgggtggacgttggatatgattggtgcgagtgcgtttacgtgggagcttcagcacatgctggggcatcatccatatacgaatgtgttggatggggtggaggaggagaggaaggagaggggggaggatgttgctttggaagaaaaggatcaggattttgaagttgccacatccggacgattatatcatattgatgccaatgtacgttatggttcggtatggaatgtcatgaggttttgggctatgaaggtcattacgatgggatatatgatgggattaccaatctactttcatggagtactgaggggagttggattgtttgttattgggcatttggcgtgtggagagttgttggcgacgatgtttattgtgaatcacgtcattgagggtgtgagttatggaacgaaggatttggttggtggtgcgagtcatgtagatgagaagaagattgtcaagccaacgactgtattgggagatacaccaatggtaaagactcgcgaggaggcattgaaaagcaacagcaataacaacaagaagaagggagagaagaactcggtaccatccgttccattcaacgactgggcagcagtccaatgccagacctccgtgaattggtctccaggctcatggttctggaatcacttttctgggggactctctcatcagattgagcatcacttgttccccagcatttgtcatacaaactactgtcatatccaggatgttgtggagagtacgtgtgctgagtacggagttccgtatcagagtgagagtaatttgtttgttgcttatggaaagatgattagtcatttgaagtttttgggtaaagccaagtgtgagtag

SEQ ID NO: 104 - protein, 503 aa, Thalassiosira pseudonana
MCNGNLPASTAQLKSTSKPQQQHEHRTISKSELAQHNTPKSAWCAVHSTPATDPSHSNNKQHAHLVLDITDFASRHPGGDLILLASGKDASVLFETYHPRGVPTSLIQKLQIGVMEEEAFRDSFYSWTDSDFYTVLKRRVVERLEERGLDRRGSKEIWIKALFLLVGFWYCLYKMYTTSDIDQYGIAIAYSIGMGTFAAFIGTCIQHDGNHGAFAQNKLLNKLAGWTLDMIGASAFTWELQHMLGHHPYTNVLDGVEEERKERGEDVALEEKDQDFEVATSGRLYHIDANVRYGSVWNVMRFWAMKVITMGYMMGLPIYFHGVLRGVGLFVIGHLACGELLATMFIVNHVIEGVSYGTKDLVGGASHVDEKKIVKPTTVLGDTPMVKTREEALKSNSNNNKKKGEKNSVPSVPFNDWAAVQCQTSVNWSPGSWFWNHFSGGLSHQIEHHLFPSICHTNYCHIQDVVESTCAEYGVPYQSESNLFVAYGKMISHLKFLGKAKCE

SEQ ID NO: 105 - DNA, 1257 bp, Thalassiosira pseudonana
  CDS (1)..(1257): Omega-3 desaturase
atgtacagattaacatccaccttcctcatcgcattggcattctcctcctccatcaatgccttctctccacaacggccaccacgtactatcaccaaaagtaaagtccaaagcaccgtgctacccataccgaccaaggatgatctgaactttctccaaccacaactcgatgagaatgatctctacctcgacgatgtcaacactccaccaagagcaggtaccatcatgaagatgttgccgaaggaaacgttcaacattgatacagcaacttcattgggttactttggtatggatatggcagcggttgtatcgtccatgacgttgctaaatgctattgtaacttcggatcagtaccatgctcttccacttcctctccaagcagcaacagtgattccctttcagctattggctgggttcgccatgtggtgtatgtggtgcattggacacgatgctggacattctactgtttcgaagacaaagtggatcaaccgagtcgttggtgaagtggctcattctgttgtttgtctcacgccgttcgtgccttggcagatgtcgcataggaaacaccatttgaatcacaatcatattgaaaaggactactctcataagtggtacagtcgcgacgagtttgatgatatcccacaactctataagacatttggctacaacccaagaatgatgcaacttccattcctctacttcatgtatcttgcattgggaattccagatggtgggcatgttgtgttctacggaagaatgtgggaaggagtgtcattgcagaagaagtttgatgctgctatttctgtggccgtatcatgtgcaactgctggatcgctttggatgaatatgggtacagcagacttcacggtggtatgcatggttccttggctagttctatcgtggtggctcttcatggtaacataccttcagcatcattcagaagacggaaagctatacactgatgaaacgtttacatttgaaaagggagccttcgagaccgtggatcgttcgtacggcaagttgatcaaccgaatgtcgcatcacatgatggacggtcacgtggtgcaccacttgttctttgaacgtgtacctcactacagattagaggcagctaccgaagctcttgtgaaaggaatggatgaaacgggacagaaacatttgtacaaatacattgatactcctgatttcaatgccgagattgtcaacggatttcgcgacaattggttccttgttgaagaggagaacatcaaaagggagtag

SEQ ID NO: 106 - protein, 418 aa, Thalassiosira pseudonana
MYRLTSTFLIALAFSSSINAFSPQRPPRTITKSKVQSTVLPIPTKDDLNFLQPQLDENDLYLDDVNTPPRAGTIMKMLPKETFNIDTATSLGYFGMDMAAVVSSMTLLNAIVTSDQYHALPLPLQAATVIPFQLLAGFAMWCMWCIGHDAGHSTVSKTKWINRVVGEVAHSVVCLTPFVPWQMSHRKHHLNHNHIEKDYSHKWYSRDEFDDIPQLYKTFGYNPRMMQLPFLYFMYLALGIPDGGHVVFYGRMWEGVSLQKKFDAAISVAVSCATAGSLWMNMGTADFTVVCMVPWLVLSWWLFMVTYLQHHSEDGKLYTDETFTFEKGAFETVDRSYGKLINRMSHHMMDGHVVHHLFFERVPHYRLEAATEALVKGMDETGQKHLYKYIDTPDFNAEIVNGFRDNWFLVEEENIKRE

SEQ ID NO: 107 - DNA, 1086 bp, Ostreococcus tauri
  CDS (1)..(1086): Delta-12 desaturase
atgcaggagggggtgcgaaacattccgaacgagtgctttgagacgggacatcttgaaagaccctggcgttccggccggtgtgggcgcgatcccggttcgaattggggcgctggcttccgctttttttcgctcaaggggttttggtggccggcgtggtgggcgtacgcgttcgtgacggggacggcggccactgggtgttgggtcgccgcgcacgagtgcgggcacggcgcgttcagcgataacaagacgttgcaagatgcggttggatacgtgttgcactcgttgctcttggtgccgtacttttcttggcagcgatcacacgcggtgcatcactcgaggacgaatcacgttcttgagggcgagacgcacgtgccggcgcgcttggggacggaagacgccaacgtcgtgttcaagcttcgcgaattgatcggtgaagggccgttcacgtttttcaacctcgtcggcgtcttcgcgctcggatggccgatttacttgctcaccggcgcgagcggcggaccggtgcgcggtaacacgaaccacttcttacccttcatgggcgagaaaggtaagcacgcgctgttcccgggtaagtgggcgaagaaggtgtggcagtctgacatcggcgttgttgccgtcctgggcgcgctcgcggcttgggcggcgcacagcgggattgccacagtgatggcactctacgtcggcccgtacatggtgaccaacttttggctcgtcttgtacacgtggttacagcacaccgacgttgacgtgccgcacttcgagggcgacgattggaacttggtcaagggggcattcatgacgatcgatcgcccgtacggcccagtttttgatttcttgcaccaccgcatcggcagcacgcacgtcgcgcaccacatcaacacaccattcccgcattacaaggctcaaatggcgacggatgcgctaaaggaggcgtatcccgacctctacctttacgatccaactccgatcgcgaccgctacgtggcgcgtggggagcaagtgcatcgccgtcgtgaagaagggagacgaatgggtgttcacggataagcaactcccggtcgcggcgtga

SEQ ID NO: 108 - protein, 361 aa, Ostreococcus tauri
MQEGVRNIPNECFETGHLERPWRSGRCGRDPGSNWGAGFRFFSLKGFWWPAWWAYAFVTGTAATGCWVAAHECGHGAFSDNKTLQDAVGYVLHSLLLVPYFSWQRSHAVHHSRTNHVLEGETHVPARLGTEDANVVFKLRELIGEGPFTFFNLVGVFALGWPIYLLTGASGGPVRGNTNHFLPFMGEKGKHALFPGKWAKKVWQSDIGVVAVLGALAAWAAHSGIATVMALYVGPYMVTNFWLVLYTWLQHTDVDVPHFEGDDWNLVKGAFMTIDRPYGPVFDFLHHRIGSTHVAHHINTPFPHYKAQMATDALKEAYPDLYLYDPTPIATATWRVGSKCIAVVKKGDEWVFTDKQLPVAA

SEQ ID NO: 109 - DNA, 1305 bp, Thalassiosira pseudonana
  CDS (1)..(1305): Delta-12 desaturase
atgggaaagggaggaagatcagtaacccgcgctcaaacagcagaaaagtcagcacacaccatccaaaccttcaccgacggccgatgggtctccccctacaaccccctcgcaaaagatgcacctgaactcccctccaagggtgaaatcaaggcggtcatccccaaagagtgcttcgaacgaagctacctccactccatgtacttcgtcctccgtgacaccgtcatggccgtggcctgcgcctacatcgcccactcaacgctctccaccgatattccctccgagttactgagcgtggacgcactcaaatggttcctcggatggaacacctacgccttttggatggggtgcattctcaccggacactgggtcctagcccatgaatgtggacatggtgcattctctccctctcagacgtttaatgacttttgggggttcattatgcatcaggcggtgttggttccgtatttcgcctggcagtactctcatgcgaagcatcatcgacgtaccaacaacattatggatggggagagccatgtgcccaatatcgccaaggaaatgggattgaacgagaagaatgagcgcagtggaggatatgccgccattcatgaggctattggagatggaccctttgcgatgtttcaaatctttgctcacttggtgatcgggtggcctatttacttgatgggatttgcttccactggacgtctcggtcaggatgggaaggaacttcaggctggagagatcatcgaccattaccgtccttggagtaagatgttccccaccaagttgcgattcaaaattgctctttcgacacttggagtgattgccgcctgggttgggttgtactttgctgcacaagagtatggagtcttgcccgtggttctttggtacattggcccactcatgtggaatcaggcgtggcttgtgctctacacttggcttcagcacaatgatccctccgtgcctcaatatggaagtgacgaatggacatgggtcaagggagctttgtcgacgattgatcgcccgtatggtatctttgacttcttccatcacaagattggaagcactcacgtagctcatcatttgttccacgagatgccattttacaaggcggatgtggctactgcgtcgatcaagggtttcttggagccgaagggactttacaactatgatccaacgccttggtatgtggccatgtggagggtggccaagacttgtcattatattgaggatgtggatggagttcagtattataagagtttggaggatgtgcctttgaagaaggatgccaagaagtctgattag

SEQ ID NO: 110 - protein, 434 aa, Thalassiosira pseudonana
MGKGGRSVTRAQTAEKSAHTIQTFTDGRWVSPYNPLAKDAPELPSKGEIKAVIPKECFERSYLHSMYFVLRDTVMAVACAYIAHSTLSTDIPSELLSVDALKWFLGWNTYAFWMGCILTGHWVLAHECGHGAFSPSQTFNDFWGFIMHQAVLVPYFAWQYSHAKHHRRTNNIMDGESHVPNIAKEMGLNEKNERSGGYAAIHEAIGDGPFAMFQIFAHLVIGWPIYLMGFASTGRLGQDGKELQAGEIIDHYRPWSKMFPTKLRFKIALSTLGVIAAWVGLYFAAQEYGVLPVVLWYIGPLMWNQAWLVLYTWLQHNDPSVPQYGSDEWTWVKGALSTIDRPYGIFDFFHHKIGSTHVAHHLFHEMPFYKADVATASIKGFLEPKGLYNYDPTPWYVAMWRVAKTCHYIEDVDGVQYYKSLEDVPLKKDAKKSD

SEQ ID NO: 111 - DNA, 879 bp, Ostreococcus tauri; identical to SEQ ID NO: 69
  CDS (1)..(879): Delta-6 elongase

SEQ ID NO: 112 - protein, 292 aa, Ostreococcus tauri; identical to SEQ ID NO: 70

SEQ ID NO: 113 - DNA, 903 bp, Ostreococcus tauri; identical to SEQ ID NO: 77
  CDS (1)..(903): Delta-5 elongase

SEQ ID NO: 114 - protein, 300 aa, Ostreococcus tauri; identical to SEQ ID NO: 78

SEQ ID NO: 115 - protein, 13 aa, Consensus
  MISC_FEATURE (1)..(13): Xaa in the sequence at positions 2, 3, 4, 6, 7, 8 and 9 has the meaning given in Table A.
NXXXHXXMYXYYX

SEQ ID NO: 116 - protein, 10 aa, Consensus
  MISC_FEATURE (1)..(10): Xaa at positions  3, 4, 5 and 6 the sequence has the meaning given in Table A.
HHXXXXWAWW

SEQ ID NO: 117 - DNA, 909 bp, Xenopus laevis
  CDS (1)..(909): Delta-5 elongase
atggccttcaaggagctcacatcaagggcagtgctcctgtatgatgaatggattaaagatgctgatcctagggttgaagactggccactcatgtcctctcctatcctacaaaccatcatcatcggcgcttacatctactttgtcacatcattgggcccaaggatcatggagaacaggaagccgtttgctctgaaggagatcatggcatgttacaacttattcatggttctgttttctgtgtacatgtgctatgagtttctcatgtcgggctgggctactggatattcctttagatgtgacattgttgactactctcagtcacctcaggcgttacggatggcctggacctgctggctcttctatttttcaaagttcattgaattattagacactgttttctttgtgctgcgtaagaagaacagccagattacattcctgcacgtctatcaccactccattatgccttggacgtggtggtttggagtcaaatttgctccaggtggtttgggcacattccatgcactggtgaactgtgtggtccatgttatcatgtacagctactacggcctgtcagccttggggcctgcctaccagaagtacctgtggtggaaaaagtacatgacgtctatccaactgacccagttcttgatggttacttttcacatcggccagttcttcttcatggagaattgcccgtaccagtatcccgtcttcttgtatgtcatttggctgtacgggttcgttttcttaatcttgttcctcaacttctggttccacgcttacatcaaaggacagaggctgccgaaagccgtccaaaatggccactgcaagaacaacaacaaccaagaaaacacttggtgcaagaacaaaaaccagaaaaacggtgcattgaaaagcaaaaaccattga

SEQ ID NO: 118 - protein, 302 aa, Xenopus laevis
MAFKELTSRAVLLYDEWIKDADPRVEDWPLMSSPILQTIIIGAYIYFVTSLGPRIMENRKPFALKEIMACYNLFMVLFSVYMCYEFLMSGWATGYSFRCDIVDYSQSPQALRMAWTCWLFYFSKFIELLDTVFFVLRKKNSQITFLHVYHHSIMPWTWWFGVKFAPGGLGTFHALVNCVVHVIMYSYYGLSALGPAYQKYLWWKKYMTSIQLTQFLMVTFHIGQFFFMENCPYQYPVFLYVIWLYGFVFLILFLNFWFHAYIKGQRLPKAVQNGHCKNNNNQENTWCKNKNQKNGALKSKNH

SEQ ID NO: 119 - DNA, 870 bp, Ciona intestinalis
  CDS (1)..(870): Delta-5 elongase
atggacgtacttcatcgtttcttaggattctacgaatggacgctgactttcgcggacccccgagtggcaaaatggcctttaatagaaaacccccttcctacaattgctattgtgttgctgtacctggcgtttgttctgtatattgggccgcgttttatgcgaaaaagagcaccagttgactttggtttattcctccctggatataactttgctttggttgcattaaattattatatcctgcaagaagtggtcactgggagttatggggctgggtatgatttggtttgcacaccacttcgaagtgattcctacgatcccaatgaaatgaaggttgcaaacgctgtatggtggtattatgtatccaagataatagagttgtttgatactgtgttgttcactctacgcaaacgagaccgacaagtaactttccttcatgtttatcaccattctaccatgcccctgttgtggtggattggggcaaagtgggtgcctggtgggcaatcatttgttggcatcatactgaactccagtgttcatgttatcatgtatacgtactatggattgtcagccttggggcctcacatgcagaagtttctatggtggaagaaatatatcacaatgttgcaactggttcaatttgttcttgccatctaccatactgctcgatcattgtacgttaaatgtccctcgcctgtttggatgcactgggcacttatcttgtacgctttctcattcattttgcttttctcaaacttctacatgcatgcctatatcaagaaatcaagaaaagggaaagagaatggcagtcgaggaaaaggtggtgtaagtaatggaaaggaaaagctgcacgctaatggtaaaaccgattaa

SEQ ID NO: 120 - protein, 289 aa, Ciona intestinalis
MDVLHRFLGFYEWTLTFADPRVAKWPLIENPLPTIAIVLLYLAFVLYIGPRFMRKRAPVDFGLFLPGYNFALVALNYYILQEVVTGSYGAGYDLVCTPLRSDSYDPNEMKVANAVWWYYVSKIIELFDTVLFTLRKRDRQVTFLHVYHHSTMPLLWWIGAKWVPGGQSFVGIILNSSVHVIMYTYYGLSALGPHMQKFLWWKKYITMLQLVQFVLAIYHTARSLYVKCPSPVWMHWALILYAFSFILLFSNFYMHAYIKKSRKGKENGSRGKGGVSNGKEKLHANGKTD

SEQ ID NO: 121 - DNA, 30 bp, Artificial sequence
  Primer
aggatccatggccttcaaggagctcacatc

SEQ ID NO: 122 - DNA, 35 bp, Artificial sequence
  Primer
cctcgagtcaatggtttttgcttttcaatgcaccg

SEQ ID NO: 123 - DNA, 25 bp, Artificial sequence
  Primer
taagcttatggacgtacttcatcgt

SEQ ID NO: 124 - DNA, 26 bp, Artificial sequence
  Primer
tcagatctttaatcggttttaccatt

SEQ ID NO: 125 - DNA, 34 bp, Artificial sequence
  Primer
gcggccgcaccatggccttcaaggagctcacatc

SEQ ID NO: 126 - DNA, 38 bp, Artificial sequence
  Primer
gcggccgccttcaatggtttttgcttttcaatgcaccg

SEQ ID NO: 127 - DNA, 29 bp, Artificial sequence
  Primer
gcggccgcaccatggacgtacttcatcgt

SEQ ID NO: 128 - DNA, 27 bp, Artificial sequence
  Primer
gcggccgctttaatcggttttaccatt

SEQ ID NO: 129 - DNA, 60 bp, Artificial sequence
  Primer
gtcgacccgcggactagtgggccctctagacccgggggatccggatctgctggctatgaa

SEQ ID NO: 130 - DNA, 60 bp, Artificial sequence; identical to SEQ ID NO: 129
  Primer

SEQ ID NO: 131 - DNA, 789 bp, Euglena gracilis
  CDS (1)..(789): Delta-5 elongase
atgctgggggccatcgcggacgtcgtgctccgggggcccgccgcattccactgggaccctgccaccaccccgctcgcatcgatcgtcagcccctgtgtggcctccgtggcgtacctgggggccatcgggctgctgaagcgccgcactggaccggaggtccgctccaagcccttcgagctgctacacaacgggctgctggtgggctggtccctcgtggtgctgctcgggacgctgtacggcgcgttccagcgcgtgcaggaggacggccggggggtgcaggccctcctgtgcacccagcggccaccatctcagatctgggacggcccggtggggtacttcacgtacctcttctacctcgcgaagtactgggagctggcggacactgtcatcctcgccctccgccagaagcccaccatccccctccacgtctaccatcacgccgtcatgctgttcatcgtgtggtcgtggttcgcgcacccctggctcgaggggagctggtggtgctccctggtcaactctttcatccacacggtgatgtactcgtactacaccctgacggtggttggcatcaacccttggtggaagaagtggatgaccaccatgcagatcatccagttcatcacgggctgcgtgtacgtcatggcgttcttcggcctatattatgccggggcgggctgcacctccaacgtgtacactgcctggttctcgatgggggtcaacctcagctttctgtggctcttcgctcttttcttccgccggtcatacagcaaacctagccggaaggagtag

SEQ ID NO: 132 - protein, 262 aa, Euglena gracilis
MLGAIADVVLRGPAAFHWDPATTPLASIVSPCVASVAYLGAIGLLKRRTGPEVRSKPFELLHNGLLVGWSLVVLLGTLYGAFQRVQEDGRGVQALLCTQRPPSQIWDGPVGYFTYLFYLAKYWELADTVILALRQKPTIPLHVYHHAVMLFIVWSWFAHPWLEGSWWCSLVNSFIHTVMYSYYTLTVVGINPWWKKWMTTMQIIQFITGCVYVMAFFGLYYAGAGCTSNVYTAWFSMGVNLSFLWLFALFFRRSYSKPSRKE

SEQ ID NO: 133 - DNA, 789 bp, Euglena gracilis
  CDS (1)..(789): Delta-5 elongase
atgctgggggccatcgcggacgtcgtgctccgggggcccgccgcattccactgggaccctgccaccaccccgctcgcatcgatcgtcagcccctgtgtggcctccgtggcgtacctgggggccatcgggctgctgaagcgccgcactggaccggaggtccgctccaagcccttcgagctgctacacaacgggctgctggtgggctggtccctcgtggtgctgctcgggacgctgtacggcgcgtaccagcgcgtgcaggaggacggccggggggtgcaggccctgctgtgcacccagcggccaccatctcagatctgggacggcccggtggggtacttcacgtaccttttctacctcgcgaagtactgggagctggtggacactgtcatcctcgccctccgccagaagcccaccatccccctccacgtctaccatcacgccgtcatgctgttcattgtgtggtcgtggttcgcgcacccctggctcgaggggagctggtggtgctccctggtcaactctttcatccacacggtgatgtactcgtattacaccctgacggtggttggcatcaacccttggtggaagaagtggatgaccaccatgcagatcatccagttcatcacgggctgcgtgtacgtcacggcgttcttcggcctatactatgccggggcgggctgcacctccaacgtgtacactgcctggttctcgatgggggtcaacctcagctttctgtggctcttcgctcttttcttccgccggtcgtacagcaaacctagccggaaggagtag

SEQ ID NO: 134 - protein, 262 aa, Euglena gracilis
MLGAIADVVLRGPAAFHWDPATTPLASIVSPCVASVAYLGAIGLLKRRTGPEVRSKPFELLHNGLLVGWSLVVLLGTLYGAYQRVQEDGRGVQALLCTQRPPSQIWDGPVGYFTYLFYLAKYWELVDTVILALRQKPTIPLHVYHHAVMLFIVWSWFAHPWLEGSWWCSLVNSFIHTVMYSYYTLTVVGINPWWKKWMTTMQIIQFITGCVYVTAFFGLYYAGAGCTSNVYTAWFSMGVNLSFLWLFALFFRRSYSKPSRKE

SEQ ID NO: 135 - DNA, 897 bp, Arabidopsis thaliana
  CDS (1)..(897): Delta-5 elongase
atggcatctgtttactccaccctaacctactggctcgtccaccacccctacattgccaacttcacgtggaccgaaggtgaaacactaggctccaccgttttctttgtctttgtcgtcgtctccctttacctctccgccacattcctcctccgatacaccgtcgattcactccccacactcggtccccgcattctcaaaccaatcacagccgttcacagcctcattctcttcctcctctccttaaccatggccgttggttgcactctctccctaatctcttcctcggacccgaaggcgcgtctcttcgacgccgtttgtttccccctcgacgtgaaacctaagggaccgcttttcttttgggctcaagtcttttacctctcgaagatccttgagttcgtagacacacttctcatcatactcaacaaatcaatccaacggctctcgttcctccacgtctaccaccacgcaacggttgtgattttgtgctacctctggttacgaacacgtcaatcgatgtttcctgttgggctcgtgttgaactcgacggtccatgtgattatgtacgggtactatttcctctgcgctatcggatcgaggcccaagtggaagaagttggtgacgaattttcaaatggttcagtttgctttcggcatggggttaggagccgcttggatgctcccagagcattatttcgggtcgggttgcgccgggatttggacagtttatttcaatggtgtgtttactgcttctctattggctctcttctacaacttccactccaagaactatgagaagactacaacgtcgcctttgtataagatcgaatcctttatatttattcacggagagaggtgggcaaataaagcgattacattattttccaagaaaaacgattaa

SEQ ID NO: 136 - protein, 298 aa, Arabidopsis thaliana
MASVYSTLTYWLVHHPYIANFTWTEGETLGSTVFFVFVVVSLYLSATFLLRYTVDSLPTLGPRILKPITAVHSLILFLLSLTMAVGCTLSLISSSDPKARLFDAVCFPLDVKPKGPLFFWAQVFYLSKILEFVDTLLIILNKSIQRLSFLHVYHHATVVILCYLWLRTRQSMFPVGLVLNSTVHVIMYGYYFLCAIGSRPKWKKLVTNFQMVQFAFGMGLGAAWMLPEHYFGSGCAGIWTVYFNGVFTASLLALFYNFHSKNYEKTTTSPLYKIESFIFIHGERWANKAITLFSKKND

SEQ ID NO: 137 - DNA, 837 bp, Arabidopsis thaliana
  CDS (1)..(837): Delta-5 elongase
atggcatcaatttactcctctttaacctactggctcgttaaccacccctacatctccaattttacttggatcgaaggtgaaaccctaggctccaccgtctttttcgtatccgtcgtagtctccgtttacctctccgccacgttcctcctccgatccgccatcgattcactcccatcactcagtccacgtatcctcaaaccgatcacagccgtccacagcctaatcctctgtctcctctccttagtcatggccgtcggttgcactctctcaataacctcatctcacgcgtcttcagatccgatggcgcgtttccttcacgcgatttgctttcccgtcgacgttaaacctaacggaccgcttttcttctgggctcaagtcttctacctctcgaagatcctcgagttcggagacacgatcctcatcatactcggcaaatcaatccaacggctatccttcctccacgtgtaccaccacgcgacggttgtggtcatgtgttatctctggctccgaactcgccaatcgatgtttccgattgcgctcgtgacgaattcgacggtacacgtcatcatgtacggttactacttcctctgcgccgttggatcgaggcccaagtggaagagattggtgacggattgtcagattgttcagtttgttttcagtttcgggttatccggttggatgctccgagagcacttattcgggtcgggttgcaccgggatttggggatggtgtttcaacgctgcatttaatgcttctcttttggctctcttttccaacttccattcaaagaattatgtcaagaagccaacgagagaggatggcaaaaaaagcgattag

SEQ ID NO: 138 - protein, 278 aa, Arabidopsis thaliana
MASIYSSLTYWLVNHPYISNFTWIEGETLGSTVFFVSVVVSVYLSATFLLRSAIDSLPSLSPRILKPITAVHSLILCLLSLVMAVGCTLSITSSHASSDPMARFLHAICFPVDVKPNGPLFFWAQVFYLSKILEFGDTILIILGKSIQRLSFLHVYHHATVVVMCYLWLRTRQSMFPIALVTNSTVHVIMYGYYFLCAVGSRPKWKRLVTDCQIVQFVFSFGLSGWMLREHLFGSGCTGIWGWCFNAAFNASLLALFSNFHSKNYVKKPTREDGKKSD

SEQ ID NO: 139 - protein, 6 aa, Artificial sequence
  Consensus
  MISC_FEATURE (3)..(3): Xaa is Val, Tyr or Ile, preferably is Val or Thr
  MISC_FEATURE (4)..(4): Xaa is Tyr or Phe, preferably is Tyr
LHXXHH

SEQ ID NO: 140 - protein, 8 aa, Artificial sequence
  Consensus
  MISC_FEATURE (2)..(2): Xaa is Asn, Asp, Thr, Gln, Met, Ser or Ala, preferably is Gln
  MISC_FEATURE (3)..(3): Xaa is Thr, Cys, Leu, Met, Ala, Ile, Val or Phe, preferably is Ala or Met
  MISC_FEATURE (5)..(5): Xaa is Met, Ile or Leu, preferably is Met
  MISC_FEATURE (6)..(6): Xaa is Val, Ile, Leu, Thr or Phe, preferably is Leu
TXXQXXQF

SEQ ID NO: 141 - protein, 6 aa, Artificial sequence
  Consensus
  MISC_FEATURE (3)..(3): Xaa is Leu, Ile, Val, Tyr, Phe or Ala, preferably is Phe
DTXFMV

SEQ ID NO: 142 - protein, 8 aa, Artificial sequence
  Consensus
  MISC_FEATURE (5)..(5): Xaa is Met, Ile or Leu, preferably is Met or Leu, especially preferably is Met
  MISC_FEATURE (6)..(6): Xaa is Val, Ile, Leu, Thr or Phe, preferably is Leu
TQAQXXQF

SEQ ID NO: 143 - DNA, 60 bp, Artificial sequence; identical to SEQ ID NO: 129
  Primer

SEQ ID NO: 144 - DNA, 60 bp, Artificial sequence; identical to SEQ ID NO: 129
  Primer

SEQ ID NO: 145 - DNA, 36 bp, Artificial sequence
  Primer
ggtaccacataatgtgcgtggagacggaaaataacg

SEQ ID NO: 146 - DNA, 33 bp, Artificial sequence
  Primer
ctcgagttacgccgtctttccggagtgttggcc

SEQ ID NO: 147 - DNA, 24 bp, Artificial sequence
  Primer
gcggccgcttacgtggacttggtc

SEQ ID NO: 148 - DNA, 24 bp, Artificial sequence
  Primer
gcggccgcatggcgacgaaggagg

SEQ ID NO: 149 - DNA, 25 bp, Artificial sequence
  Primer
taagcttacatggcgacgaaggagg

SEQ ID NO: 150 - DNA, 24 bp, Artificial sequence
  Primer
tggatccacttacgtggacttggt

SEQ ID NO: 151 - DNA, 60 bp, Artificial sequence; identical to SEQ ID NO: 129
  Primer

SEQ ID NO: 152 - DNA, 31 bp, Artificial sequence
  Primer
gcggccgcaccatgtgctcaccaccgccgtc

SEQ ID NO: 153 - DNA, 26 bp, Artificial sequence
  Primer
gcggccgcctacatggcaccagtaac

SEQ ID NO: 154 - DNA, 31 bp, Artificial sequence
  Primer
gcggccgcaccatgtgctcatcaccgccgtc

SEQ ID NO: 155 - DNA, 26 bp, Artificial sequence
  Primer
gcggccgcctacatggcaccagtaac

SEQ ID NO: 156 - DNA, 31 bp, Artificial sequence
  Primer
gcggccgcaccatggacgcctacaacgctgc

SEQ ID NO: 157 - DNA, 27 bp, Artificial sequence
  Primer
gcggccgcctaagcactcttcttcttt

SEQ ID NO: 158 - DNA, 23 bp, Artificial sequence
  Primer
accatgtgctcaccaccgccgtc

SEQ ID NO: 159 - DNA, 18 bp, Artificial sequence
  Primer
ctacatggcaccagtaac

SEQ ID NO: 160 - DNA, 23 bp, Artificial sequence
  Primer
accatgtgctcatcaccgccgtc

SEQ ID NO: 161 - DNA, 18 bp, Artificial sequence
  Primer
ctacatggcaccagtaac

SEQ ID NO: 162 - DNA, 23 bp, Artificial sequence
  Primer
accatggacgcctacaacgctgc

SEQ ID NO: 163 - DNA, 19 bp, Artificial sequence
  Primer
ctaagcactcttcttcttt

SEQ ID NO: 164 - DNA, 60 bp, Artificial sequence; identical to SEQ ID NO: 129
  Primer

SEQ ID NO: 165 - DNA, 60 bp, Artificial sequence; identical to SEQ ID NO: 129
  Primer

SEQ ID NO: 166 - DNA, 29 bp, Artificial sequence
  Primer
gcggccgcataatgacgagcaacatgagc

SEQ ID NO: 167 - DNA, 29 bp, Artificial sequence
  Primer
gcggccgcttaggccgacttggccttggg

SEQ ID NO: 168 - DNA, 34 bp, Artificial sequence
  Primer
gcggccgcaccatggacgtcgtcgagcagcaatg

SEQ ID NO: 169 - DNA, 36 bp, Artificial sequence
  Primer
gcggccgcttagatggtcttctgcttcttgggcgcc

SEQ ID NO: 170 - DNA, 23 bp, Artificial sequence
  Primer
gacataatgacgagcaacatgag

SEQ ID NO: 171 - DNA, 25 bp, Artificial sequence
  Primer
cggcttaggccgacttggccttggg

SEQ ID NO: 172 - DNA, 30 bp, Artificial sequence
  Primer
agacataatggacgtcgtcgagcagcaatg

SEQ ID NO: 173 - DNA, 28 bp, Artificial sequence
  Primer
ttagatggtcttctgcttcttgggcgcc

SEQ ID NO: 174 - DNA, 60 bp, Artificial sequence; identical to SEQ ID NO: 129
  Primer

SEQ ID NO: 175 - DNA, 29 bp, Artificial sequence
  Primer
gcggccgcataatggcttcaacatggcaa

SEQ ID NO: 176 - DNA, 32 bp, Artificial sequence
  Primer
gcggccgcttatgtcttcttgctcttcctgtt

SEQ ID NO: 177 - DNA, 26 bp, Artificial sequence
  Primer
gcggccgcataatggagacttttaat

SEQ ID NO: 178 - DNA, 28 bp, Artificial sequence
  Primer
gcggccgctcagtcccccctcactttcc

SEQ ID NO: 179 - DNA, 29 bp, Artificial sequence
  Primer
aagcttacataatggcttcaacatggcaa

SEQ ID NO: 180 - DNA, 30 bp, Artificial sequence
  Primer
ggatccttatgtcttcttgctcttcctgtt

SEQ ID NO: 181 - DNA, 26 bp, Artificial sequence
  Primer
aagcttacataatggagacttttaat

SEQ ID NO: 182 - DNA, 27 bp, Artificial sequence
  Primer
ggatccttcagtcccccctcactttcc

SEQ ID NO: 183 - DNA, 993 bp, Phaeodactylum tricornutum
  CDS (103)..(939): Delta-6 elongase
ggtcttttgtggtagctatcgtcatcacacgcaggtcgttgctcactatcgtgatccgtatattgaccgtgcacttgtgtaaaacagagatatttcaagagtatgatggtaccttcaagttatgacgagtatatcgtcatggtcaacgaccttggcgactctattctgagctgggccgaccctgatcactatcgtggacataccgagggatgggagttcactgacttttctgctgcttttagcattgccgtcgcgtacctcctgtttgtctttgttggatctctcattatgagtatgggagtccccgcaattgacccttatccgctcaagtttgtctacaatgtttcacagattatgctttgtgcttacatgaccattgaagccagtcttctagcttatcgtaacggctacacattctggccttgcaacgattgggactttgaaaagccgcctatcgctaagctcctctggctcttttacgtttccaaaatttgggatttttgggacaccatctttattgttctcgggaagaagtggcgtcaactttccttcctgcacgtctaccatcacaccaccatctttctcttctactggttgaatgcacatgtaaactttgatggtgatattttcctcaccatcgtcttgaacggtttcatccacaccgtcatgtacacgtactacttcatttgcatgcacaccaaggtcccagagaccggcaaatccttgcccatttggtggaaatctagtttgacaagcatgcagctggtgcagttcatcacgatgatgacgcaggctatcatgatcttgtacaagggctgtgctgctccccatagccgggtggtgacatcgtacttggtttacattttgtcgctctttattttgttcgcccagttctttgtcagctcatacctcaagccgaagaagaagaagacagcttaagcgaaatttgggtctacgttaaaacaattacgttacaaaaaaaaaaaaaaaaaa

SEQ ID NO: 184 - protein, 278 aa, Phaeodactylum tricornutum
MMVPSSYDEYIVMVNDLGDSILSWADPDHYRGHTEGWEFTDFSAAFSIAVAYLLFVFVGSLIMSMGVPAIDPYPLKFVYNVSQIMLCAYMTIEASLLAYRNGYTFWPCNDWDFEKPPIAKLLWLFYVSKIWDFWDTIFIVLGKKWRQLSFLHVYHHTTIFLFYWLNAHVNFDGDIFLTIVLNGFIHTVMYTYYFICMHTKVPETGKSLPIWWKSSLTSMQLVQFITMMTQAIMILYKGCAAPHSRVVTSYLVYILSLFILFAQFFVSSYLKPKKKKTA

SEQ ID NO: 185 - DNA, 20 bp, Artificial sequence
  Primer
  misc_feature (1)..(20): N in positions 3 and 18 is C or T.
aanctuctutggctuttnta

SEQ ID NO: 186 - DNA, 23 bp, Artificial sequence
  Primer
  misc_feature (1)..(23): N in positions 3 and 15 is C or T. N in positions 9, 12 and 21 is A or G.
gantguacnaanaantgugcnaa

SEQ ID NO: 187 - DNA, 446 bp, Artificial sequence
  PCR fragment
  misc_feature (1)..(446): PCR fragment
aagctcctctggctcttttacgtttccaaaatttgggatttttgggacaccatctttattgttctcgggaagaagtggcgtcaactttccttcctgcacgtctaccatcacaccaccatctttctcttctactggttgaatgcacatgtaaactttgatggtgatattttcctcaccatcgtcttgaacggtttcatccacaccgtcatgtacacgtactacttcatttgcatgcacaccaaggtcccagagaccggcaaatccttgcccatttggtggaaatctagtttgacaagcatgcagctggtgcagttcatcacgatgatgacgcaggctatcatgatcttgtacaagggctgtgctgctccccatagccgggtggtgacatcgtacttggtttacattttgtcgctctttattttgttcgcccagttctttgtcagctc

SEQ ID NO: 188 - DNA, 30 bp, Artificial sequence
  Primer
gcggccgcacataatgatggtaccttcaag

SEQ ID NO: 189 - DNA, 22 bp, Artificial sequence
  Primer
gaagacagcttaatagactagt

SEQ ID NO: 190 - DNA, 31 bp, Artificial sequence
  Primer
gcggccgcaccatgatggtaccttcaagtta

SEQ ID NO: 191 - DNA, 24 bp, Artificial sequence
  Primer
gaagacagcttaataggcggccgc

SEQ ID NO: 192 - DNA, 859 bp, Artificial sequence
  PCR product
gcggccgcacataatgatggtaccttcaagttatgacgagtatatcgtcatggtcaacgaccttggcgactctattctgagctgggccgaccctgatcactatcgtggacataccgagggatgggagttcactgacttttctgctgcttttagcattgccgtcgcgtacctcctgtttgtctttgttggatctctcattatgagtatgggagtccccgcaattgacccttatccgctcaagtttgtctacaatgtttcacagattatgctttgtgcttacatgaccattgaagccagtcttctagcttatcgtaacggctacacattctggccttgcaacgattgggactttgaaaagccgcctatcgctaagctcctctggctcttttacgtttccaaaatttgggatttttgggacaccatctttattgttctcgggaagaagtggcgtcaactttccttcctgcacgtctaccatcacaccaccatctttctcttctactggttgaatgcacatgtaaactttgatggtgatattttcctcaccatcgtcttgaacggtttcatccacaccgtcatgtacacgtactacttcatttgcatgcacaccaaggtcccagagaccggcaaatccttgcccatttggtggaaatctagtttgacaagcatgcagctggtgcagttcatcacgatgatgacgcaggctatcatgatcttgtacaagggctgtgctgctccccatagccgggtggtgacatcgtacttggtttacattttgtcgctctttattttgttcgcccagttctttgtcagctcatacctcaagccgaagaagaagaagacagcttaatagactagt

SEQ ID NO: 193 - DNA, 1380 bp, Phytium irregulare
  CDS (1)..(1380): Delta-6 desaturase
atggtggacctcaagcctggagtgaagcgcctggtgagctggaaggagatccgcgagcacgcgacgcccgcgaccgcgtggatcgtgattcaccacaaggtctacgacatctccaagtgggactcgcacccgggtggctccgtgatgctcacgcaggccggcgaggacgccacggacgccttcgcggtcttccacccgtcctcggcgctcaagctgctcgagcagttctacgtcggcgacgtggacgaaacctccaaggccgagatcgagggggagccggcgagcgacgaggagcgcgcgcgccgcgagcgcatcaacgagttcatcgcgtcctaccgccgtctgcgcgtcaaggtcaagggcatggggctctacgacgccagcgcgctctactacgcgtggaagctcgtgagcacgttcggcatcgcggtgctctcgatggcgatctgcttcttcttcaacagtttcgccatgtacatggtcgccggcgtgattatggggctcttctaccagcagtccggatggctggcgcacgacttcttgcacaaccaggtgtgcgagaaccgcacgctcggcaaccttatcggctgcctcgtgggcaacgcctggcagggcttcagcatgcagtggtggaagaacaagcacaacctgcaccacgcggtgccgaacctgcacagcgccaaggacgagggcttcatcggcgacccggacatcgacaccatgccgctgctggcgtggtctaaggagatggcgcgcaaggcgttcgagtcggcgcacggcccgttcttcatccgcaaccaggcgttcctatacttcccgctgctgctgctcgcgcgcctgagctggctcgcgcagtcgttcttctacgtgttcaccgagttctcgttcggcatcttcgacaaggtcgagttcgacggaccggagaaggcgggtctgatcgtgcactacatctggcagctcgcgatcccgtacttctgcaacatgagcctgtttgagggcgtggcatacttcctcatgggccaggcgtcctgcggcttgctcctggcgctggtgttcagtattggccacaacggcatgtcggtgtacgagcgcgaaaccaagccggacttctggcagctgcaggtgaccacgacgcgcaacatccgcgcgtcggtattcatggactggttcaccggtggcttgaactaccagatcgaccatcacctgttcccgctcgtgccgcgccacaacttgccaaaggtcaacgtgctcatcaagtcgctatgcaaggagttcgacatcccgttccacgagaccggcttctgggagggcatctacgaggtcgtggaccacctggcggacatcagcaaggaatttatcaccgagttcccagcgatgtaa

SEQ ID NO: 194 - protein, 459 aa, Phytium irregulare
MVDLKPGVKRLVSWKEIREHATPATAWIVIHHKVYDISKWDSHPGGSVMLTQAGEDATDAFAVFHPSSALKLLEQFYVGDVDETSKAEIEGEPASDEERARRERINEFIASYRRLRVKVKGMGLYDASALYYAWKLVSTFGIAVLSMAICFFFNSFAMYMVAGVIMGLFYQQSGWLAHDFLHNQVCENRTLGNLIGCLVGNAWQGFSMQWWKNKHNLHHAVPNLHSAKDEGFIGDPDIDTMPLLAWSKEMARKAFESAHGPFFIRNQAFLYFPLLLLARLSWLAQSFFYVFTEFSFGIFDKVEFDGPEKAGLIVHYIWQLAIPYFCNMSLFEGVAYFLMGQASCGLLLALVFSIGHNGMSVYERETKPDFWQLQVTTTRNIRASVFMDWFTGGLNYQIDHHLFPLVPRHNLPKVNVLIKSLCKEFDIPFHETGFWEGIYEVVDHLADISKEFITEFPAM

SEQ ID NO: 195 - DNA, 1152 bp, Calendula officinalis
  CDS (1)..(1152): Delta-12 desaturase
atgggtgcaggcggtcgaatgcaagatcccaccaacggtggcaacaaaaccgagcccgaaccaatccaacgggtcccacatgaaaaacccccattcacagttggagacatcaagaaagcgatcccacctcattgtttcaaccgatcggtaattcgttcattttcatacgtcttttacgacctcacaatcgcgtcaatcttgtactacattgccaacaattacatctctaccctccctagcccgctcgcctacgtggcatggcccgtttactgggccgtccaagggtgcgtcttaaccggggtgtgggtcatagcccacgaatgtggccatcatgcttttagcgaccaccaatggctcgatgacaccgtgggtctcgtcttgcactcgttcctactcgtgccctacttttcgtggaaatatagccaccgtaggcaccactcgaacacgggctcgatcgagcacgatgaggttttcgtcccgaagttgaaatcgggcgtccggtcaaccgcccggtacctaaacaacccaccgggccgaatcttgaccctactcgtaaccctaaccctcggttggcctctatacctcacgttcaacgtttcgggccgttactacgaccggttcgcgtgccatttcgacccgaatagcccgatctactcgaagcgcgaacgggctcaaatcttcatatccgacgccgggatcttagccgtagtcttcgtactcttccgactcgcaatgaccaaagggctcacgtgggtcctaaccatgtacggtggcccgttactcgtggtcaacggtttcctagtcttgatcacattcctacaacacactcacccttcgctcccgcactatgactcaaccgaatgggattggttacgtggggccctcaccacaatcgaccgtgattacgggatcctaaacaaagtgttccataacataaccgacactcacgtggcccaccatttgttctctacaatgcctcattaccatgcaatggaagccacgaaggtgatcaaaccgattttgggcgattattatcagtttgacgggacctcgatttttaaggcgatgtatcgggaaacaaaggagtgcatttatgttgataaggatgaggaggtgaaagatggtgtttattggtatcgtaataagatttaa

SEQ ID NO: 196 - protein, 383 aa, Calendula officinalis
MGAGGRMQDPTNGGNKTEPEPIQRVPHEKPPFTVGDIKKAIPPHCFNRSVIRSFSYVFYDLTIASILYYIANNYISTLPSPLAYVAWPVYWAVQGCVLTGVWVIAHECGHHAFSDHQWLDDTVGLVLHSFLLVPYFSWKYSHRRHHSNTGSIEHDEVFVPKLKSGVRSTARYLNNPPGRILTLLVTLTLGWPLYLTFNVSGRYYDRFACHFDPNSPIYSKRERAQIFISDAGILAVVFVLFRLAMTKGLTWVLTMYGGPLLVVNGFLVLITFLQHTHPSLPHYDSTEWDWLRGALTTIDRDYGILNKVFHNITDTHVAHHLFSTMPHYHAMEATKVIKPILGDYYQFDGTSIFKAMYRETKECIYVDKDEEVKDGVYWYRNKI

SEQ ID NO: 197 - DNA, 903 bp, Ostreococcus tauri
  CDS (1)..(903): Delta-5 elongase
atgtctgcttctggagctttgttgcctgctattgctttcgctgcttacgcttacgctacctacgcttatgctttcgagtggtctcatgctaacggaatcgataacgtggatgctagagagtggattggagctttgtctttgagactccctgcaattgctaccaccatgtacctcttgttctgccttgtgggacctagattgatggctaagagggaggcttttgatcctaagggattcatgctcgcttacaacgcttaccaaaccgctttcaacgttgtggtgctcggaatgttcgctagagagatctctggattgggacaacctgtttggggatctactatgccttggagcgataggaagtccttcaagattttgttgggagtgtggctccattacaacaataagtacctcgagttgttggatactgtgttcatggtggctaggaaaaagaccaagcagctctctttcttgcatgtgtaccatcatgctttgttgatttgggcttggtggcttgtttgtcatctcatggctaccaacgattgcatcgatgcttatttcggagctgcttgcaactctttcatccacatcgtgatgtactcctactacctcatgtctgctttgggaattagatgcccttggaagagatatatcacccaggctcagatgttgcaattcgtgatcgtgttcgctcatgctgttttcgtgctcagacaaaagcactgccctgttactttgccttgggcacaaatgttcgtgatgacaaatatgttggtgctcttcggaaacttctacctcaaggcttactctaacaagtctaggggagatggagcttcttctgttaagcctgctgagactactagagcaccttctgtgagaagaaccaggtccaggaagatcgattga

SEQ ID NO: 198 - protein, 300 aa, Ostreococcus tauri; identical to SEQ ID NO: 78

SEQ ID NO: 199 - DNA, 879 bp, Ostreococcus tauri
  CDS (1)..(879): Delta-6 elongase
atgtctggattgagggctcctaacttcttgcataggttctggaccaagtgggattacgctatctctaaggtggtgttcacttgcgctgattctttccagtgggatatcggacctgtttcttcttctaccgctcatttgcctgctattgagtctcctactcctttggtgacctctttgctcttctacttggtgactgtgttcttgtggtacggaagattgaccagatcctccgataagaagatcagagagcctacctggttgaggagattcatcatctgccacaacgctttcttgattgtgctctccttgtacatgtgtttgggatgcgttgctcaagcttaccaaaacggatacaccttgtggggaaacgagttcaaggctactgagacccaattggctctctacatctacatcttctacgtgtccaagatctacgagttcgtggatacctacatcatgctcctcaagaacaacctcaggcaagtgtctttcttgcacatctaccaccactctaccatctctttcatctggtggatcatcgctagaagagcacctggaggagatgcttatttctccgctgctctcaactcttgggttcatgtgtgcatgtacacttactacctcctctctaccttgattggaaaggaagatcctaagaggtctaactacctctggtggggaaggcatttgacccaaatgcaaatgctccagttcttcttcaacgtgctccaagctctttattgcgcttccttctccacttaccctaagttcctctccaagatcttgctcgtgtacatgatgtctttgctcggacttttcggacacttctactactctaagcacatcgctgctgctaagttgcaaaagaagcagcagtga

SEQ ID NO: 200 - protein, 292 aa, Ostreococcus tauri; identical to SEQ ID NO: 70

SEQ ID NO: 201 - DNA, 1421 bp, Ostreococcus tauri
  CDS (26)..(1399): Delta-6 desaturase
ggatccttaattaaggcgcgccaaaatgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacatcctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcatgttgcttacagattcgctgagttggctgctatgtacgctttgggaacctacttgatgtacgctagatacgttgtgtcctctgtgttggtttacgcttgcttcttcggagctagatgtggatgggttcaacatgagggaggacattcttctttgaccggaaacatctggtgggataagagaatccaagctttcactgctggattcggattggctggatctggagatatgtggaactccatgcacaacaagcaccatgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccatccttctaaggctttgaagggaggaaagtacgaggagcttgtgtggatgttggctgctcatgtgattagaacctggaccattaaggctgttactggattcaccgctatgcaatcctacggactcttcttggctacttcttgggtttccggatgctacttgttcgctcacttctctacttctcacacccatttggatgttgttcctgctgatgagcatttgtcttgggttaggtacgctgtggatcacaccattgatatcgatccttctcagggatgggttaactggttgatgggatacttgaactgccaagtgattcatcacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacattctggaaagaccgcttgataattaattaaggcgcgccgaattc

SEQ ID NO: 202 - protein, 456 aa, Ostreococcus tauri; identical to SEQ ID NO: 90

SEQ ID NO: 203 - DNA, 61 bp, Artificial sequence
  Primer
gaattcggcgcgccgagctcctcgagcaacggttccggcggtatagagttgggtaattcga

SEQ ID NO: 204 - DNA, 45 bp, Artificial sequence
  Primer
cccgggatcgatgccggcagatctccaccattttttggtggtgat

SEQ ID NO: 205 - DNA, 40 bp, Artificial sequence
  Primer
aggcctccatggcctgctttaatgagatatgcgagacgcc

SEQ ID NO: 206 - DNA, 32 bp, Artificial sequence
  Primer
cccgggccggacaatcagtaaattgaacggag

SEQ ID NO: 207 - DNA, 26 bp, Artificial sequence
  Primer
aggcctcaacggttccggcggtatag

SEQ ID NO: 208 - DNA, 60 bp, Artificial sequence
  Primer
cccggggttaacgctagcgggcccgatatcggatcccattttttggtggtgattggttct

SEQ ID NO: 209 - DNA, 31 bp, Artificial sequence
  Primer
aggcctcctgctttaatgagatatgcgagac

SEQ ID NO: 210 - DNA, 31 bp, Artificial sequence
  Primer
cccgggcggacaatcagtaaattgaacggag

SEQ ID NO: 211 - DNA, 28 bp, Artificial sequence
  Primer
aggcctcaacggttccggcggtatagag

SEQ ID NO: 212 - DNA, 50 bp, Artificial sequence
  Primer
aggccttctagactgcaggcggccgcccgcattttttggtggtgattggt

SEQ ID NO: 213 - DNA, 27 bp, Artificial sequence
  Primer
ggcctcctgctttaatgagatatgcga

SEQ ID NO: 214 - DNA, 51 bp, Artificial sequence
  Primer
aagcttggcgcgccgagctcgtcgacggacaatcagtaaattgaacggaga

SEQ ID NO: 215 - DNA, 30 bp, Artificial sequence
  Primer
agatctatggtggacctcaagcctggagtg

SEQ ID NO: 216 - DNA, 36 bp, Artificial sequence
  Primer
ccatggcccgggttacatcgctgggaactcggtgat

SEQ ID NO: 217 - DNA, 30 bp, Artificial sequence
  Primer
gggatccatgggcaagggcagcgagggccg

SEQ ID NO: 218 - DNA, 33 bp, Artificial sequence
  Primer
ggcgccgacaccaagaagcaggactgagatatc

SEQ ID NO: 219 - DNA, 36 bp, Artificial sequence
  Primer
gcggccgcatggaggtcgtggagagattctacggtg

SEQ ID NO: 220 - DNA, 31 bp, Artificial sequence
  Primer
gcaaaagggagctaaaactgagtgatctaga

SEQ ID NO: 221 - DNA, 31 bp, Artificial sequence
  Primer
gtcgatcaacggttccggcggtatagagttg

SEQ ID NO: 222 - DNA, 32 bp, Artificial sequence
  Primer
gtcgatcggacaatcagtaaattgaacggaga

SEQ ID NO: 223 - DNA, 28 bp, Artificial sequence
  Primer
agatctatgggtgcaggcggtcgaatgc

SEQ ID NO: 224 - DNA, 26 bp, Artificial sequence
  Primer
ccatggttaaatcttattacgatacc

SEQ ID NO: 225 - DNA, 26 bp, Artificial sequence
  Primer
agatctatggacgtcgtcgagcagca

SEQ ID NO: 226 - DNA, 32 bp, Artificial sequence
  Primer
ccatggcccgggagaagcagaagaccatctaa

SEQ ID NO: 227 - protein, 4 aa, Artificial sequence
  Cyt. B5 domain
HPGG

SEQ ID NO: 228 - protein, 5 aa, Artificial sequence
  His box1
HCANH

SEQ ID NO: 229 - protein, 5 aa, Artificial sequence
  His box1
HEGGH

SEQ ID NO: 230 - protein, 5 aa, Artificial sequence
  His box1
HECGH

SEQ ID NO: 231 - protein, 10 aa, Artificial sequence
  His box2
WRYHHQVSHH

SEQ ID NO: 232 - protein, 10 aa, Artificial sequence
  His box2
WRYHHMVSHH

SEQ ID NO: 233 - protein, 9 aa, Artificial sequence
  His box2
WNSMHNKHH

SEQ ID NO: 234 - protein, 9 aa, Artificial sequence
  His box2
WQRSHAVHH

SEQ ID NO: 235 - protein, 8 aa, Artificial sequence
  His box3
QVEHHLFP

SEQ ID NO: 236 - protein, 8 aa, Artificial sequence
  His box3
QVVHHLFP

SEQ ID NO: 237 - protein, 8 aa, Artificial sequence
  His box3
QIEHHLPF

SEQ ID NO: 238 - protein, 8 aa, Artificial sequence
  His box3
QVIHHLFP

SEQ ID NO: 239 - protein, 5 aa, Artificial sequence
  His box3
HVAHH

SEQ ID NO: 240 - protein, 5 aa, Artificial sequence
  His box1
HDGNH

SEQ ID NO: 241 - protein, 5 aa, Artificial sequence
  His box1
HDANH

SEQ ID NO: 242 - protein, 5 aa, Artificial sequence
  His box1
HDFLH

SEQ ID NO: 243 - protein, 5 aa, Artificial sequence
  His box1
HDAGH

SEQ ID NO: 244 - protein, 10 aa, Artificial sequence
  His box2
WELQHMLGHH

SEQ ID NO: 245 - protein, 9 aa, Artificial sequence
  His box2
WMAQHWTHH

SEQ ID NO: 246 - protein, 9 aa, Artificial sequence
  His box2
WLAQHWTHH

SEQ ID NO: 247 - protein, 9 aa, Artificial sequence
  His box2
WKNKHNGHH

SEQ ID NO: 248 - protein, 5 aa, Artificial sequence
  His box2
HAKHH

SEQ ID NO: 249 - protein, 11 aa, Artificial sequence
  His box2
WLFMVTYLQHH

SEQ ID NO: 250 - protein, 8 aa, Artificial sequence
  His box3
QIEHHLFP

SEQ ID NO: 251 - protein, 8 aa, Artificial sequence
  His box3
QVDHHLFP

SEQ ID NO: 252 - protein, 8 aa, Artificial sequence
  His box3
HVAHHLFH

SEQ ID NO: 253 - protein, 7 aa, Artificial sequence
  His box3
HVVHHLF

SEQ ID NO: 254 - protein, 7 aa, Artificial sequence
  Corresponding amino acids to primer Phaelo forward1
NLLWLFY

SEQ ID NO: 255 - protein, 8 aa, Artificial sequence
  Corresponding amino acids to primer Phaelo reverse1
FAQFFVQS

We claim:

1. A recombinant nucleic acid molecule comprising one or more regulatory sequences functionally linked to a heterologous nucleic acid sequence selected from the group consisting of:
   a) a nucleic acid sequence having at least 80% sequence identity to the nucleic acid sequence of SEQ ID NO: 197, wherein said nucleic acid sequence encodes a polypeptide having Δ5-elongase activity; and
   b) a nucleic acid sequence encoding a polypeptide having at least 80% sequence identity to the amino acid sequence of SEQ ID NO: 198, wherein said polypeptide has Δ5-elongase activity.

2. The recombinant nucleic acid molecule of claim 1, wherein said nucleic acid sequence encodes a polypeptide having at least 90% sequence identity to the amino acid sequence of SEQ ID NO: 198, wherein said polypeptide has Δ5-elongase activity.

3. The recombinant nucleic acid molecule of claim 1, wherein said nucleic acid sequence encodes a polypeptide having at least 95% sequence identity to the amino acid sequence of SEQ ID NO: 198, wherein said polypeptide has Δ5-elongase activity.

4. The recombinant nucleic acid molecule of claim 1, wherein said nucleic acid sequence comprises:
   a) the nucleic acid sequence of SEQ ID NO: 197; or
   b) a nucleic acid sequence encoding a polypeptide comprising the amino acid sequence of SEQ ID NO: 198.

5. A vector comprising the recombinant nucleic acid molecule of claim 1.

6. A host cell comprising:
   a) the recombinant nucleic acid molecule of claim 1; or
   b) a vector comprising said recombinant nucleic acid molecule.

7. The host cell of claim 6, wherein the host cell is a plant cell, a bacterial cell, an insect cell, a yeast cell, or a fungal cell.

8. A transgenic plant, plant cell or plant part comprising:
   a) the recombinant nucleic acid molecule of claim 1; or
   b) a vector comprising said recombinant nucleic acid molecule.

9. The transgenic plant of claim 8, wherein said plant is an oil-producing plant.

10. A method for the manufacture of polyunsaturated fatty acids, comprising:
    a) cultivating the host cell of claim 6 under conditions which allow for the production of polyunsaturated fatty acids in said host cell; and
    b) obtaining said polyunsaturated fatty acids from said host cell.

11. The method of claim 10, wherein the polyunsaturated fatty acid is arachidonic acid (ARA), eicosapentaenoic acid (EPA), and/or docosahexaenoic acid (DHA).

12. A method for the manufacture of polyunsaturated fatty acids, comprising:
    a) cultivating the transgenic plant of claim 8 under conditions which allow for the production of polyunsaturated fatty acids in said plant or seeds thereof; and
    b) obtaining said polyunsaturated fatty acids from said plant or seeds thereof.

13. The method of claim 12, wherein the polyunsaturated fatty acids are obtained from the seeds of said plant.

14. The method of claim 12, comprising obtaining an oil-, lipid- or fatty acid-composition from said plant or seeds thereof, and obtaining the polyunsaturated fatty acids from said oil-, lipid- or fatty acid-composition.

15. The method of claim 12, wherein the polyunsaturated fatty acid is arachidonic acid (ARA), eicosapentaenoic acid (EPA), and/or docosahexaenoic acid (DHA).

16. A method for the manufacture of an oil-, lipid- or fatty acid-composition, comprising:
   a) cultivating the transgenic plant of claim 8 under conditions which allow for the production of polyunsaturated fatty acids in said plant or seeds thereof; and
   b) obtaining an oil-, lipid- or fatty acid-composition from said plant or seeds thereof.

17. The method of claim 16, wherein the oil-, lipid- or fatty acid-composition is obtained from the seeds of said plant.

18. The method of claim 16, wherein the oil-, lipid- or fatty acid-composition comprises arachidonic acid (ARA), eicosapentaenoic acid (EPA), and/or docosahexaenoic acid (DHA).

19. The method of claim 16, wherein the oil-, lipid- or fatty acid-composition is used for feed, foodstuffs, cosmetics, or pharmaceuticals.

20. An isolated nucleic acid molecule comprising the nucleic acid sequence of SEQ ID NO: 197.

* * * * *